United States Patent 8,014,957 (GENES ASSOCIATED WITH PROGRESSION AND RESPONSE IN CHRONIC MYELOID LEUKEMIA AND USES THEREOF) - sequence listing, part 4

SEQ ID NO: 6769 - DNA, 60 bp, Homo sapiens
ggtagctttttctacatcttactcctgttgatgcagctaaggtacatttgtaaaaagaaa

SEQ ID NO: 6770 - DNA, 60 bp, Homo sapiens
gtccaggaaattacaatagctgttaaggaaaggaaataatggtacagatctttttctgtc

SEQ ID NO: 6771 - DNA, 60 bp, Homo sapiens
aatgctgtggttgtgctcaatgtctccttgcggtctccacacacacactccatggcccga

SEQ ID NO: 6772 - DNA, 60 bp, Homo sapiens
aactggctactgagtcatgatccttgctgataaatataaccatcaataaagaagcattct

SEQ ID NO: 6773 - DNA, 60 bp, Homo sapiens
cagaaaaagaaaaatgagctcaaaatttgctttgagagctacagggaattgctattactc

SEQ ID NO: 6774 - DNA, 60 bp, Homo sapiens
ggttttggacattcagagagatgaattgtgagaacagcaaagaaatccatcagaaaaaca

SEQ ID NO: 6775 - DNA, 60 bp, Homo sapiens
atcatgttcaatttcagtagtttgatcagttgaaggctagaagtgtgaagtgcagatgag

SEQ ID NO: 6776 - DNA, 60 bp, Homo sapiens
ggacacacacagactatttttagattttcttttgccttttgcaaccaggaacagcaaatg

SEQ ID NO: 6777 - DNA, 60 bp, Homo sapiens
ccaagaatttcccttctaccctctattctcttgtgtctgtaagttacaaagtcaggaaaa

SEQ ID NO: 6778 - DNA, 60 bp, Homo sapiens
atggagtgtgtattgttcccagtgacacttcagagagctggtagttagtagcatgttgag

SEQ ID NO: 6779 - DNA, 60 bp, Homo sapiens
gaccaatcatcagactccttgaactcccccactctgctggctctgtaacccagtgcacct

SEQ ID NO: 6780 - DNA, 60 bp, Homo sapiens
aggcacatgaagagaaagcattccaaagcctctgattgttgtttcctttttctcctcccg

SEQ ID NO: 6781 - DNA, 60 bp, Homo sapiens
aaagtaaattcactgtatctaatgatgttacagacttacgtatacccttgtatacctggg

SEQ ID NO: 6782 - DNA, 60 bp, Homo sapiens
aaccttcccttttgacccttttggattttatcaggtgtaaacaaaaagctgaacagttac

SEQ ID NO: 6783 - DNA, 60 bp, Homo sapiens
aaggaattcctctatgaagcctaactcttgaggtctctaacataccttgtcatagaggaa

SEQ ID NO: 6784 - DNA, 60 bp, Homo sapiens
ggtggaggctattttcattaaaactgtcagaatttgcttaccataattatgatacagtcc

SEQ ID NO: 6785 - DNA, 60 bp, Homo sapiens
tctggagggccggacagggaggtggaaaccccaggggctggcttttttaaaactggtttt

SEQ ID NO: 6786 - DNA, 60 bp, Homo sapiens
tgatccagtgatattcaagagagctacatttgaagcctgtacaaaagcttatccctgtaa

SEQ ID NO: 6787 - DNA, 60 bp, Homo sapiens
ccccttcctctacgcctttctagatgacaacttccggaagaacttccgcagcatattgcg

SEQ ID NO: 6788 - DNA, 60 bp, Homo sapiens
caccatttctctagatcgcctagtctcaacccataaaaaggaagaactgacaaaggggat

SEQ ID NO: 6789 - DNA, 60 bp, Homo sapiens
tgcaggaggtcggttttcatggtcattcagttccacagatctgaatgattactgtctgtc

SEQ ID NO: 6790 - DNA, 60 bp, Homo sapiens
actttggactcttccctgcaaattatgtcaagcttctggagtgactagagctcactgtct

SEQ ID NO: 6791 - DNA, 60 bp, Homo sapiens
aggcaatttccagtatgttaagtaacacacttatttttcctgtgtatggagagattcaag

SEQ ID NO: 6792 - DNA, 60 bp, Homo sapiens
gttctcaatttcctgtgtttgcaatgttgaaattttttggtgaagtactgaacttgcttt

SEQ ID NO: 6793 - DNA, 60 bp, Homo sapiens
ggctgggaatgtatgtttttataatttgtttatttaaatatgaaaaataaaatgttaaac

SEQ ID NO: 6794 - DNA, 60 bp, Homo sapiens
gggacggggactggccctcccttgcaggtcggtttggtttgttgtaaataaaagtattta

SEQ ID NO: 6795 - DNA, 60 bp, Homo sapiens
agggagctctattttctttaccagaaatgttgctaagtaattcccaatagaaagctgctt

SEQ ID NO: 6796 - DNA, 60 bp, Homo sapiens
gcatcgtgtacttaccagtgtgttcacaaaatgaaatttgtgtgagagctgtacattaaa

SEQ ID NO: 6797 - DNA, 60 bp, Homo sapiens
acccttgaagaggacccttgtcccaaacccttcttgttctctcctccaaaagtagcttcc

SEQ ID NO: 6798 - DNA, 60 bp, Homo sapiens
cctgtggtctccttggaaatccgtctagttaacatttcaagggcaataccgtgttggttt

SEQ ID NO: 6799 - DNA, 60 bp, Homo sapiens
gctaaaacacgagctaatgttgacaaggtattttttgatttaatgagagaaattcgagcg

SEQ ID NO: 6800 - DNA, 60 bp, Homo sapiens
agttttaccagcagaactctctaaaggattgcttcaagtctctggacaccaccttgcagt

SEQ ID NO: 6801 - DNA, 60 bp, Homo sapiens
tttctgtttacgtaacctgcttagtattgacactctctaccaagagggtcttcctaagaa

SEQ ID NO: 6802 - DNA, 60 bp, Homo sapiens
ggaaccatgacgattgtagatatttaatattgtacagtatagaaacctccgatttttgcc

SEQ ID NO: 6803 - DNA, 60 bp, Homo sapiens
ataactttttcctctcgattcccatccccaatttaatattaaattaacaggcaagccggc

SEQ ID NO: 6804 - DNA, 60 bp, Homo sapiens
tgggacatgaacgttttaacatagtaaatcctctttttgatgagtttctgaaactggagc

SEQ ID NO: 6805 - DNA, 60 bp, Homo sapiens
gagcgagactatgagaagatgtttggcacgaaatgccatggctgtgacttcaagatcgac

SEQ ID NO: 6806 - DNA, 60 bp, Homo sapiens
tattttgtaaaagactttctagtgtacaagacaccattgtgtccaactgtatatagctgc

SEQ ID NO: 6807 - DNA, 60 bp, Homo sapiens
cccaagttatcccactagctgattactatatcattgctggagtgatctatcaggcaccag

SEQ ID NO: 6808 - DNA, 60 bp, Homo sapiens
agtgacccctatcatgtgtatatcaagaaccgtgtgtctatgatctaacacgagagggct

SEQ ID NO: 6809 - DNA, 60 bp, Homo sapiens
attgtgaaccatggtgaagtgcttggaacatactgttcactcactctaaaggcgctgaga

SEQ ID NO: 6810 - DNA, 60 bp, Homo sapiens
tgccctgccgtacttcttccttttagcccttatttattgtcggtctgcccatgggactgg

SEQ ID NO: 6811 - DNA, 60 bp, Homo sapiens
atcctcttgtactgggagaggtgccttttgtatccccaattaaaggtagaaaaccaccct

SEQ ID NO: 6812 - DNA, 60 bp, Homo sapiens
ttcaaatgtgactccacctcttaaaagccgtgatttctagcagttgacttcacctctgtg

SEQ ID NO: 6813 - DNA, 60 bp, Homo sapiens
ttatatgaagaaatagaagaggggcttgaagtccccctcgcgagtgccttcttgcaatta

SEQ ID NO: 6814 - DNA, 60 bp, Homo sapiens
aatgattctgctccctttgaaagcattcattttgctagaactgttagacacattgcagta

SEQ ID NO: 6815 - DNA, 60 bp, Homo sapiens
gtactgtagcaggggaattccctccccctccttgtgccttctttgtatataggcttctca

SEQ ID NO: 6816 - DNA, 60 bp, Homo sapiens
tcactgaagtgggaactatgaatctttttctttactggataaatgaagatggagaagaag

SEQ ID NO: 6817 - DNA, 60 bp, Homo sapiens
gggcaaacctgtgacccttttctactggaatagaaatgagttttatcatctttgaaaaat

SEQ ID NO: 6818 - DNA, 60 bp, Homo sapiens
ccatgctgccaacttctaaccgcaatagtgactctgtgcttgtctgtttagttctgtgta

SEQ ID NO: 6819 - DNA, 60 bp, Homo sapiens
tgtctcttccctcaagacctttcctaccatgaagatgtttgaatatgtcaggaatgaccg

SEQ ID NO: 6820 - DNA, 60 bp, Homo sapiens
ggcctcgggaccaactctttgtataacctacctgaatgtattaaaaactaattttggaaa

SEQ ID NO: 6821 - DNA, 60 bp, Homo sapiens
ctgtcctagcagttgtggtcatcggagctgtggtcgctgctgtgatgtgtaggaggaaga

SEQ ID NO: 6822 - DNA, 60 bp, Homo sapiens
ctcacgcctcccctatgtgtcttaggggactctggcttctctttttgcaagggcctctga

SEQ ID NO: 6823 - DNA, 60 bp, Homo sapiens
atagacttaactcccttaagcccagacatctgttgagacctgacccctagtcattggtta

SEQ ID NO: 6824 - DNA, 60 bp, Homo sapiens
aatgccttagaatcctatgcttttaacatgaagagtgttgtgagtgatgaaggtttgaag

SEQ ID NO: 6825 - DNA, 60 bp, Homo sapiens
atctcgtttccggaaaaggagcaagaagatgttctccaaacgctttgaaccaaagcatgg

SEQ ID NO: 6826 - DNA, 60 bp, Homo sapiens
accccacattcccatgatggaagtctgcgtaaccaataaattgtgcctttctcactcaaa

SEQ ID NO: 6827 - DNA, 60 bp, Homo sapiens
ataattgcaagttgtataactcaggcgtctttgcatttctgcgaaagatcaaggtctgca

SEQ ID NO: 6828 - DNA, 60 bp, Homo sapiens
cgtcctgtttaggaaaaagaagtgtgactactggatcaggacttttgttccaggttgcca

SEQ ID NO: 6829 - DNA, 60 bp, Homo sapiens
cacaagggttttatcctttcctttaaaaacagtgtttgaaatgaagactgtcaactatcc

SEQ ID NO: 6830 - DNA, 60 bp, Homo sapiens
gctgtgctatcatgatggaatttcatatctacagatagagagttgttgtgtacagacttg

SEQ ID NO: 6831 - DNA, 60 bp, Homo sapiens
attgttccctatgaaagattccacagagatgtttatggtgaggtttaaaggatatgaaac

SEQ ID NO: 6832 - DNA, 60 bp, Homo sapiens
agggaagggagggaggtctgttctatctgttgctgtaaataaagatatttgtccatctct

SEQ ID NO: 6833 - DNA, 60 bp, Homo sapiens
ggtctcaaagaggaagagcctttaaatctacaagacagcagccttcccgaaatgtcacta

SEQ ID NO: 6834 - DNA, 60 bp, Homo sapiens
tccaagattgagattctgcgcctggccatctgctatatctcctacctgaaccacgtgctg

SEQ ID NO: 6835 - DNA, 60 bp, Homo sapiens
cctgggcctgatgttctgcctgattgctttgagcaccgatttctggtttgaggctgtggg

SEQ ID NO: 6836 - DNA, 60 bp, Homo sapiens
taagaaatgaatctgattgttgtcaacacatttgtgaagtcttgtgctataaaggggaac

SEQ ID NO: 6837 - DNA, 60 bp, Homo sapiens
tttaagcatcatgaagaacaatttatgttcacattaagatacgttctaaagggggatggc

SEQ ID NO: 6838 - DNA, 60 bp, Homo sapiens
cccccaaccacaggcatcaggcaaccatttgaaataaaactccttcagcctgtgaaaaaa

SEQ ID NO: 6839 - DNA, 60 bp, Homo sapiens
agacctcattcagttctacaacaacatctacatcaaacagattaagacatttgccatgaa

SEQ ID NO: 6840 - DNA, 60 bp, Homo sapiens
gttataactacactctctccaagacagagttcctaagcttcatgaatacagaactagctg

SEQ ID NO: 6841 - DNA, 60 bp, Homo sapiens
aggagcttgcaaacaccatcaagaatatcaaagataaagctgtcattgatgaaatattcc

SEQ ID NO: 6842 - DNA, 60 bp, Homo sapiens
ggacttgctcagccagattcagtttccattccaatcacctgctgctttaacgtgatcaat

SEQ ID NO: 6843 - DNA, 60 bp, Homo sapiens
actgtcgccttaactatgttaagcatctagactaaaagccaaaatataattattgctgcc

SEQ ID NO: 6844 - DNA, 60 bp, Homo sapiens
tgccaaaagtttagacctaacccaatattgctttcctgagaaatctctgctcttgttggg

SEQ ID NO: 6845 - DNA, 60 bp, Homo sapiens
gtgtcagacgtacagccagacatgttctctattggcatttttccgattctgttcagatga

SEQ ID NO: 6846 - DNA, 60 bp, Homo sapiens
tgcgcaccgtgtcctcctccgtcatcgagcagctcttcttcgtccgtttggtaggtaaaa

SEQ ID NO: 6847 - DNA, 60 bp, Homo sapiens
ctttccagaatcccgtaacacctgattaactgaggcatccacttctttcagcagactgat

SEQ ID NO: 6848 - DNA, 60 bp, Homo sapiens
tgcaaaaaactacagacatctctgtgctgtttattacaacaagaatcctgggtttgagat

SEQ ID NO: 6849 - DNA, 60 bp, Homo sapiens
tgcaatggtatgaatctgctcatgtggagactggctataaactgaaaagtgtattctaaa

SEQ ID NO: 6850 - DNA, 60 bp, Homo sapiens
attgcagccctgtctacactggataatcattccctggccatatcagtcatcatgatggtt

SEQ ID NO: 6851 - DNA, 60 bp, Homo sapiens
atattttgctcactatccctccccacttgcttccctgatatgtgctctgacttccctgaa

SEQ ID NO: 6852 - DNA, 60 bp, Homo sapiens
ttaccaaatcggccaagaagctcagaagcagtaatgcagatgctgaagaaaagttggacc

SEQ ID NO: 6853 - DNA, 60 bp, Homo sapiens
cgtccaagaaaaaactgcaggaaagcctattttgttctagtattaacaggtactagaaga

SEQ ID NO: 6854 - DNA, 60 bp, Homo sapiens
tggcggtgggtttttgtatctgaatttgctgtcttgaacataaagaatctatctgctgtt

SEQ ID NO: 6855 - DNA, 60 bp, Homo sapiens
ttgggatctcaaaagatttggttcagatccaaacaaatacacattctgtgttttagctca

SEQ ID NO: 6856 - DNA, 60 bp, Homo sapiens
ccttgaaggacctcaagatcaaatgacctgtgaggaatatgttgccttcatcctaactgc

SEQ ID NO: 6857 - DNA, 60 bp, Homo sapiens
gtggaattcacaactactcagactgggaaaatacagattggttcaaagaaaccaaaaacc

SEQ ID NO: 6858 - DNA, 60 bp, Homo sapiens
cttcttagacacaagaattgcatcgatgaaattgagaccataatcagtgttaagctccag

SEQ ID NO: 6859 - DNA, 60 bp, Homo sapiens
tgcttacagattcatggtttgataaatttgttgtattccaaaacttgaaatgcaggacgc

SEQ ID NO: 6860 - DNA, 60 bp, Homo sapiens
taagggattctccgttttggttccattttgtacacgtttggaaaataatctgcagaaacg

SEQ ID NO: 6861 - DNA, 60 bp, Homo sapiens
ggacaagatattgaatacatagaaatacggtctgatgccgatgaaaatgtatcagcttct

SEQ ID NO: 6862 - DNA, 60 bp, Homo sapiens
tgctttaccatatatcaggaattatatccaggatgcaatactcagacactagcttttttc

SEQ ID NO: 6863 - DNA, 60 bp, Homo sapiens
ggctggttgctggttagattttctgaaacaggaggtaaaatttttctttggcagaggccc

SEQ ID NO: 6864 - DNA, 60 bp, Homo sapiens
agatgatcctgaaacgcaggaagtccctcaagcagaagaagaagcggtaatgcgcccgga

SEQ ID NO: 6865 - DNA, 60 bp, Homo sapiens
agggggaaattggggattgtgtctttccctgttgaaaatgtttggatgggaataaatatc

SEQ ID NO: 6866 - DNA, 60 bp, Homo sapiens
gccctggggattccactccagtaaagtagaatgaaggatacaaatgataaaaattacact

SEQ ID NO: 6867 - DNA, 60 bp, Homo sapiens
gctcagaaacaactcttgcatgtaaaagtcttatttgatgaaaagaagaaatgcaagtgg

SEQ ID NO: 6868 - DNA, 60 bp, Homo sapiens
caagttaactgaggacaaggcagacgtgcagtccatcatcggcctgcagcgcttcttcga

SEQ ID NO: 6869 - DNA, 60 bp, Homo sapiens
gcagaagcagaaaaaggcaaacgagaagaaggaggaacccaagtagctttgtggcttcgt

SEQ ID NO: 6870 - DNA, 60 bp, Homo sapiens
gaaattggccgatttcaagaacacatctccttttcaaccccattccttatctgctccaac

SEQ ID NO: 6871 - DNA, 60 bp, Homo sapiens
tcacaatagctctgtgatgtaaatgctatctccatgagaaaattcataaagggtgttttg

SEQ ID NO: 6872 - DNA, 60 bp, Homo sapiens
gtgagtgttggaaatcctttagtaaccactctagcctcgttaaacaccgaagagttcata

SEQ ID NO: 6873 - DNA, 60 bp, Homo sapiens
ccttacacccaaccagatcgtttctaccctcttcacctccaacttcattggcatctgctt

SEQ ID NO: 6874 - DNA, 60 bp, Homo sapiens
acacctaccttacagtgttatgaccttgtatacacatatattggtatcaaaggggataaa

SEQ ID NO: 6875 - DNA, 60 bp, Homo sapiens
aacttcctaattaaatcagactgtttgagcctgttgtctagaatattttcctgaccaaga

SEQ ID NO: 6876 - DNA, 60 bp, Homo sapiens
caagccatctatccaggcattaattcatggactaaacagacattattactccattactat

SEQ ID NO: 6877 - DNA, 60 bp, Homo sapiens
atcaacatgctctacttcaatgacaagcagcagattatctacggcaagatccctggcatg

SEQ ID NO: 6878 - DNA, 60 bp, Homo sapiens
ccctccagattactacggctatgaagattactatgatgattactatggttatgattatca

SEQ ID NO: 6879 - DNA, 60 bp, Homo sapiens
caactctctcactctgaaccatgaagctgagaaagaggattcagttgacaaagtaatgag

SEQ ID NO: 6880 - DNA, 60 bp, Homo sapiens
agccccacactcacatgtacgaagttctcaccccagctcctttgtgtggcaccctgatga

SEQ ID NO: 6881 - DNA, 60 bp, Homo sapiens
gctattatggaaataccatgtaatagggagagttgaacatgaatattagagaaggaatcc

SEQ ID NO: 6882 - DNA, 60 bp, Homo sapiens
atgatgagccgtatgttttgctgcaaaataaagagagcctattttacaagatggtgcaac

SEQ ID NO: 6883 - DNA, 60 bp, Homo sapiens
gataacaacacttatgaaaacagaagagtactttccaactatgaaaggccatagaaacgt

SEQ ID NO: 6884 - DNA, 60 bp, Homo sapiens
ctgcttaccccatagccacatttgtggatgagtggtttgtgattaaaagggatgttcttg

SEQ ID NO: 6885 - DNA, 60 bp, Homo sapiens
ttgatgctcagaatcgcctacctgtgcctgcgtgtaaaccacagcctcagaccagctatg

SEQ ID NO: 6886 - DNA, 60 bp, Homo sapiens
agaggcctatatactgtgatagcttgtatggggaaaaacaacttttgatgtgatctgatt

SEQ ID NO: 6887 - DNA, 60 bp, Homo sapiens
tgccagtgtttctttgctaagccttgcatgcaaaatttgaaattttaacattggcaccca

SEQ ID NO: 6888 - DNA, 60 bp, Homo sapiens
cacaatcaaatatcactcccctggtacttccagcttccaactctagggattcatgattct

SEQ ID NO: 6889 - DNA, 60 bp, Homo sapiens
tcagctggggaacgagagtaatttgaagaatgcttgaagtcagcgtcttccattccagaa

SEQ ID NO: 6890 - DNA, 60 bp, Homo sapiens
gcaggacccaatttctgttttatatgttcatgaactttaaacctggaaacatgtccttac

SEQ ID NO: 6891 - DNA, 60 bp, Homo sapiens
tatccctacattttttaattaaagcaacagacttctcaataaaagcaggtcgtctcgttc

SEQ ID NO: 6892 - DNA, 60 bp, Homo sapiens
atttatattgtcattttataacactctagcccctgcccttattgggggacagatggtccc

SEQ ID NO: 6893 - DNA, 60 bp, Homo sapiens
aactgagccctggggctgctgctgtaatttataaggcaaattttattaaatttgtaacta

SEQ ID NO: 6894 - DNA, 60 bp, Homo sapiens
gacagtgtaggaaattgtctattcctgatataattactgtagtactcttgcttaaggcaa

SEQ ID NO: 6895 - DNA, 60 bp, Homo sapiens
ccaagtttacagcttgtactttactttaatgtgtaatactcaactcacggtacaagacaa

SEQ ID NO: 6896 - DNA, 60 bp, Homo sapiens
ccgaggaccgtccatggaccttatttttatatgagattaataaagatgtttgcaaaagaa

SEQ ID NO: 6897 - DNA, 60 bp, Homo sapiens
tggtacaggtactgatgaaaatctctagtggataatcataacactctcggtcacatgttt

SEQ ID NO: 6898 - DNA, 60 bp, Homo sapiens
aagatccctagtgggtgtagtctgaaaatttttaacaaccaagaatttgctcagttattg

SEQ ID NO: 6899 - DNA, 60 bp, Homo sapiens
cccagtgcatatgcaatgtatagtgtctattatcacattaatctcaaagagattcgaatg

SEQ ID NO: 6900 - DNA, 60 bp, Homo sapiens
tgatgttactaaatgcttcaaagctgaagaatctaaatgtcgtctttgactcaagtacca

SEQ ID NO: 6901 - DNA, 60 bp, Homo sapiens
acatgtgcagtaattagattatcatgggtgaactttatgagtgagtatcttggtgatgac

SEQ ID NO: 6902 - DNA, 60 bp, Homo sapiens
gaaacactctacacctctaatcaaggtcatgtagtaatgactttgttataaatgctacag

SEQ ID NO: 6903 - DNA, 60 bp, Homo sapiens
ccaaagacaatgtgccacagatcttttgttctctgtaatgaggattaattgctgtttaaa

SEQ ID NO: 6904 - DNA, 60 bp, Homo sapiens
ctcccaagtacaaatagagtgacccgtaaaatctaggattttttgttttttgctacaatc

SEQ ID NO: 6905 - DNA, 60 bp, Homo sapiens
gtcccgctgcgtgttttcctcttgatcgggaactcctgcttctccttgcctcgaaatgga

SEQ ID NO: 6906 - DNA, 60 bp, Homo sapiens
cacctgcgccggctcctgcaaatgcaaagagtgcaaatgcacctcctgcaagaaaagctg

SEQ ID NO: 6907 - DNA, 60 bp, Homo sapiens
ctgtggtgaagtgttcctggtgttccctttccctgctgaccttggaggaatgacaataaa

SEQ ID NO: 6908 - DNA, 60 bp, Homo sapiens
cttgcagatcgcagtgaattttccttggggaacatcgctgttttgtcctagagtgaactt

SEQ ID NO: 6909 - DNA, 60 bp, Homo sapiens
ctgaggaaaagcctcatgtaaaaccctatttctctaagaccattcgcgatttagaagttg

SEQ ID NO: 6910 - DNA, 60 bp, Homo sapiens
tgtggagagtgctcggcctaaccttagaacacaattgtaactgaaaacagtgttttcaat

SEQ ID NO: 6911 - DNA, 60 bp, Homo sapiens
gcgtggctcgggacgctcatgtaaatttggttttggtgctcaagggttctttcctcccag

SEQ ID NO: 6912 - DNA, 60 bp, Homo sapiens
aagagcttggatgtgaatcaggactcggagctcaagttcaatgagtactggagattgatt

SEQ ID NO: 6913 - DNA, 60 bp, Homo sapiens
attattcccctaggctgagcctgctcatgtacctctgattaataaatgcttatgaaaaaa

SEQ ID NO: 6914 - DNA, 60 bp, Homo sapiens
gaaatatcctcctgtgacaccttccccaccctgccagtcaaagtatccacccaagagcaa

SEQ ID NO: 6915 - DNA, 60 bp, Homo sapiens
ccccagattctgattctacagctgcagaatgtatataacacaataaaagcaaatgtttga

SEQ ID NO: 6916 - DNA, 60 bp, Homo sapiens
gtcccagctcagttttccaaaagacactgacatgtaattcttctctattgtaaggtttcc

SEQ ID NO: 6917 - DNA, 60 bp, Homo sapiens
cctgtggaacaattggactgattcatgctattgcaaacaataaagacaagatgcactttg

SEQ ID NO: 6918 - DNA, 60 bp, Homo sapiens
aatgcaatccattcctctcttgtttatagtaatctaagggttgagcagttaaaacggctt

SEQ ID NO: 6919 - DNA, 60 bp, Homo sapiens
ttccagaacaagttctactcaggcacgggctacaagctgagtcccttcaccttcgctgcc

SEQ ID NO: 6920 - DNA, 60 bp, Homo sapiens
accccttttaagaatttggcacagttactcactttgtgtaatctgaaatctagctgctga

SEQ ID NO: 6921 - DNA, 60 bp, Homo sapiens
caaactcaatgagctctggaaaaactttggatttaaaaaagattctgaaaagcttcctcc

SEQ ID NO: 6922 - DNA, 60 bp, Homo sapiens
ggaagtgttcagtaaaagtatgcactgttagattactgataacgcggatagatttttgtt

SEQ ID NO: 6923 - DNA, 60 bp, Homo sapiens
catttagaagtgatccagcaaagattgggagggtactaccagattctacttcaaagaaat

SEQ ID NO: 6924 - DNA, 60 bp, Homo sapiens
tcacacaaaatactgggtggcttggtttagagctaattgtagtggaagcctgcaaggttg

SEQ ID NO: 6925 - DNA, 60 bp, Homo sapiens
ctgggtggaattccagaacaagttctactcaggcacgggctacaagctgagtcccttcac

SEQ ID NO: 6926 - DNA, 60 bp, Homo sapiens
aaagtattggaaggaaattgtctacgtgtcttggaaaaattagttaggaatttggatggg

SEQ ID NO: 6927 - DNA, 60 bp, Homo sapiens
ctctactattgagctgtagacgaactgtttctctaattataaagcaaactgtttgggata

SEQ ID NO: 6928 - DNA, 60 bp, Homo sapiens
caagcaagggtctccttcaagattaatgctatcaatcattaaggtcattactctcaacca

SEQ ID NO: 6929 - DNA, 60 bp, Homo sapiens
ctagctccactctaaggctaagcatcttcaaagacgttttcccatatgctgtcttaattc

SEQ ID NO: 6930 - DNA, 60 bp, Homo sapiens
agcaaacttgaagaattggtccatttcttacaagtcatgtatcccaaactgtgtcagcac

SEQ ID NO: 6931 - DNA, 60 bp, Homo sapiens
agccatcttacttggctttttactattaacatgatgtactaaagtagagccctttgagaa

SEQ ID NO: 6932 - DNA, 60 bp, Homo sapiens
caatgtcatagacactgatttcatcgacgaggaagttcttatgtccttggtgatagaaat

SEQ ID NO: 6933 - DNA, 60 bp, Homo sapiens
gtggatgagcaaatgcttaatgtccaaaacaaaaacagcagctattttgttgagtggatc

SEQ ID NO: 6934 - DNA, 60 bp, Homo sapiens
aggcaaccttgtctctatccatgacttcaacttcaactatcgcattcagtgctgcactag

SEQ ID NO: 6935 - DNA, 60 bp, Homo sapiens
agtttaaggaggctttcaacatgattgaccagaaccgtgatggcttcattgacaaggagg

SEQ ID NO: 6936 - DNA, 60 bp, Homo sapiens
actctgtattccctcttggggtgaccacagcttctccctttcccaaccaataaagtaacc

SEQ ID NO: 6937 - DNA, 60 bp, Homo sapiens
taaaaagaatacaagcattccatgtacacatgttaattagcagttagtgattgggccaac

SEQ ID NO: 6938 - DNA, 60 bp, Homo sapiens
tctactttgagactgtgctttatcaggacatcactctgagtatccgtccagagactcact

SEQ ID NO: 6939 - DNA, 60 bp, Homo sapiens
gagctaaaactcaactatagaagacattaaaagaaatcgtattcttgccaagtaaccacc

SEQ ID NO: 6940 - DNA, 60 bp, Homo sapiens
gtgtagagttctaataccaaagacagaagtaaatgttttccatatactttgtcttgcctg

SEQ ID NO: 6941 - DNA, 60 bp, Homo sapiens
tggggagatacatcttatagagttagaaatagaatctgaatttctaaagggagattctgg

SEQ ID NO: 6942 - DNA, 60 bp, Homo sapiens
tgccttgagaatttcaaaagaggtaatcaggaaaagagagagagaaaaactacacgctgt

SEQ ID NO: 6943 - DNA, 60 bp, Homo sapiens
cacaggtgacatagatatgatatgacaactggtaatggtggattcatttacattgtttac

SEQ ID NO: 6944 - DNA, 60 bp, Homo sapiens
ggactgcttttctctcactaaatatagcagttaatatccagtcattaaggagttgtcact

SEQ ID NO: 6945 - DNA, 60 bp, Homo sapiens
ctggaaaaataggcctactaaagatgaatcacacttgagatgtttcttactcactctgca

SEQ ID NO: 6946 - DNA, 60 bp, Homo sapiens
aacctactgattaatgtttctggtgatttggaaaatagatacaactttccaagctctgag

SEQ ID NO: 6947 - DNA, 60 bp, Homo sapiens
gagggaaagcatgtctgctgggtgtgaccatgtttcctctcaataaagttcccctgtgac

SEQ ID NO: 6948 - DNA, 60 bp, Homo sapiens
gctgacggaaaaagcaaaaattaacaaatatgtgactatccttcatctacctaaaaaggg

SEQ ID NO: 6949 - DNA, 60 bp, Homo sapiens
ttcatggactatggactctttcaaagggatctgatccttttgaattttgcacagccctag

SEQ ID NO: 6950 - DNA, 60 bp, Homo sapiens
acaaggctaaactgcctggaacagaatccttctgcattgttcttgtaccacatttttcct

SEQ ID NO: 6951 - DNA, 60 bp, Homo sapiens
ctggtcttctctacagttcacagaggtctttcagctcatttaatcccaggaaagaggcat

SEQ ID NO: 6952 - DNA, 60 bp, Homo sapiens
tggagcttgacaaaatcacaaaaggaaaattactggggcaaaattagacctcaagtctgc

SEQ ID NO: 6953 - DNA, 60 bp, Homo sapiens
ttcccaagcctgcccaaagacttgctccacacaacgccctgtttcattccttaccactag

SEQ ID NO: 6954 - DNA, 60 bp, Homo sapiens
aagcacactcacttaaagaaaaaacgagttctttcgttctgtgcgcagtaaaaggggcgc

SEQ ID NO: 6955 - DNA, 60 bp, Homo sapiens
ccttgcctccttttttcttaaagcaaagtcacttctccatcacaaccagatttgaggctg

SEQ ID NO: 6956 - DNA, 60 bp, Homo sapiens
aacagtgtaggttccctcaataacccctttctgctgttctcccatgatccaactgtgtaa

SEQ ID NO: 6957 - DNA, 60 bp, Homo sapiens
gcactcacactcccttgatgctgtctgtacagggttcatattttgtagcgaaagtcgttt

SEQ ID NO: 6958 - DNA, 60 bp, Homo sapiens
gcatttcaaacttgaccaccttttcctaccagctagttagaagtcatcaatatttctcta

SEQ ID NO: 6959 - DNA, 60 bp, Homo sapiens
gaaatagccatctgctataactctttcaacagaaaaccaaaaccaaacgaaatgtctaag

SEQ ID NO: 6960 - DNA, 60 bp, Homo sapiens
ttcgattccttactgtagctaattctagatgcccttcagtattgtgaacaaatagaccgt

SEQ ID NO: 6961 - DNA, 60 bp, Homo sapiens
aagattatgatgcctcctccaagaatgacttcattggccagagtaccatccccttgaaca

SEQ ID NO: 6962 - DNA, 60 bp, Homo sapiens
cagctcttctcagtgtctgaacaatctccaaaattgaaatgtatatttttgctaggagcc

SEQ ID NO: 6963 - DNA, 60 bp, Homo sapiens
agtggcccatcctgtcttctacttgaaacgtctgagtcacttgtctaaaaagtagcctca

SEQ ID NO: 6964 - DNA, 60 bp, Homo sapiens
atacattactgtactctggaatttaggcaaaaccttaaatctccaggctttttaaagcac

SEQ ID NO: 6965 - DNA, 60 bp, Homo sapiens
cagtaatcatggtctactcctctttccgtggctgggggtagacttaataaagagagaaat

SEQ ID NO: 6966 - DNA, 60 bp, Homo sapiens
aatgacgggaaacatcaaaatccaccccttcttcaagaccataaactggactctgctgga

SEQ ID NO: 6967 - DNA, 60 bp, Homo sapiens
tatttgaaaacactgctgttctttaaatgcgttcctcatccatgcagataacagctggtt

SEQ ID NO: 6968 - DNA, 60 bp, Homo sapiens
gcataattcggctcatctccttagctgcccagaaattcatctcagatattgccaatgatg

SEQ ID NO: 6969 - DNA, 60 bp, Homo sapiens
taccaggtatttttataacaatcagacaaaacagtgtgaacgtttcaagtatggtggatg

SEQ ID NO: 6970 - DNA, 60 bp, Homo sapiens
ctccccagagtattaactctccaagagtattattaacgctgctgtacctcgatctgaatc

SEQ ID NO: 6971 - DNA, 60 bp, Homo sapiens
atggcctgaaaatatttgtgatccataactctacacagcctttactcatactattaggca

SEQ ID NO: 6972 - DNA, 60 bp, Homo sapiens
gatattgttaatataataataattattttttagagtactgcttttgtatgtatgttgaac

SEQ ID NO: 6973 - DNA, 60 bp, Homo sapiens
gacttctctaatcagttacgagctgaactagagaaacatggttataagatggagacttca

SEQ ID NO: 6974 - DNA, 60 bp, Homo sapiens
acactctactgttaatgacagatgttctgtttttataacctaccaaaaggaaactagagg

SEQ ID NO: 6975 - DNA, 60 bp, Homo sapiens
ggtctgtacaggtgttctttattttacatgagggctactttccaaccaaataaagtcaat

SEQ ID NO: 6976 - DNA, 60 bp, Homo sapiens
ctctcatcctacttagcctacctagatttctcatgacgagttaatgcatgtccgtggttg

SEQ ID NO: 6977 - DNA, 60 bp, Homo sapiens
gtgcttttcctccagtttgctggctggcttctccgtctacccacagtgacctcacagaga

SEQ ID NO: 6978 - DNA, 60 bp, Homo sapiens
gttaattgaggcaatgtcatctgctcaaagttgagtggtttattcacaataaactgtaag

SEQ ID NO: 6979 - DNA, 60 bp, Homo sapiens
actctttttgtcacagttagagaatgaggttgactaatgcatattatgaattgagtccac

SEQ ID NO: 6980 - DNA, 60 bp, Homo sapiens
gctaaatcaagagcagcttaatcctgtttacaatgtgagctttttgtgcgtctgtgaaat

SEQ ID NO: 6981 - DNA, 60 bp, Homo sapiens
tgaatggaggacacttcagtagttcatctaggatccttttattaaggacagtttgggagt

SEQ ID NO: 6982 - DNA, 60 bp, Homo sapiens
ccaaagctgaaatccagaaagttctaaaagaaaaagaccaacttaccacagatctgaact

SEQ ID NO: 6983 - DNA, 60 bp, Homo sapiens
cgctctgggagagaaataagcactgggagattggaagcactgctaacattttgaattttt

SEQ ID NO: 6984 - DNA, 60 bp, Homo sapiens
gatatttcttgctttaagagagagacagaatctctcactgaaactcatggtcatgatttt

SEQ ID NO: 6985 - DNA, 60 bp, Homo sapiens
ttctcgttaagatgcatagtaaacattctgagaacagcttacttctcactaaaacagaac

SEQ ID NO: 6986 - DNA, 60 bp, Homo sapiens
gccatgatttctggagagcttgacattctcaaagactggtgctatgaagctacttacagc

SEQ ID NO: 6987 - DNA, 60 bp, Homo sapiens
ccctctctgaaaatctttcttgttcaaaacagcaacgacatatcttgttaacttttacgg

SEQ ID NO: 6988 - DNA, 60 bp, Homo sapiens
acatcacctctgagaataggagaaatgaagcaacagttgtgtctagatgtcagaggcatg

SEQ ID NO: 6989 - DNA, 60 bp, Homo sapiens
attgacgccgtaagaactaaaatggtctactgcaaaattgatcagacccagagaaaagta

SEQ ID NO: 6990 - DNA, 60 bp, Homo sapiens
cgagtatttcaaggatagcagaaatgtgaagaagcttaaagaccctaccttgcggttccg

SEQ ID NO: 6991 - DNA, 60 bp, Homo sapiens
tgaaacctccactgcaggctggttttaggtcttgaattatgtaagaatcttgcacagcac

SEQ ID NO: 6992 - DNA, 60 bp, Homo sapiens
gtctgctcataagtacttgtgtcatccagaatgttttgttttttaagaaaattgaattac

SEQ ID NO: 6993 - DNA, 60 bp, Homo sapiens
gaggactcgacattgtccacagatgtactggccattacatgaaacaagaaaccaagcatc

SEQ ID NO: 6994 - DNA, 60 bp, Homo sapiens
atcctcactggtgtgctgtccacagatttgtgaactcctggtagtaaaacacttttgcat

SEQ ID NO: 6995 - DNA, 60 bp, Homo sapiens
catggagacaagagtcaaccagaaagagattgggtacttaatgagttccgttctggaaag

SEQ ID NO: 6996 - DNA, 60 bp, Homo sapiens
gatttcctgtagctgtgaattgttaaaatgtatgattcaggataaaacgtaaacacgtgc

SEQ ID NO: 6997 - DNA, 60 bp, Homo sapiens
aaattgtactttgctccattgttaattgagaaactgtttcaataaaatattcttttctac

SEQ ID NO: 6998 - DNA, 60 bp, Homo sapiens
gacaaatgtacagcttgttcttccaaagttcttgatcaatatgaacgagaaggatttaac

SEQ ID NO: 6999 - DNA, 60 bp, Homo sapiens
gcaggcccaatgcagaagagtattaagaaagatgctcaagtcccatggcacagagcaagg

SEQ ID NO: 7000 - DNA, 60 bp, Homo sapiens
gatcatggaactatagagctaccagacatatcctgctctctaagggaatttattgctatc

SEQ ID NO: 7001 - DNA, 60 bp, Homo sapiens
cacctgaggcgttcaaaagatataaccaaataaacaagtcatccacaatcaaaatacaac

SEQ ID NO: 7002 - DNA, 60 bp, Homo sapiens
cagtacagacagtagagttcttcggctactccttactcactggttatgtcttcttcctca

SEQ ID NO: 7003 - DNA, 60 bp, Homo sapiens
ctcttcattattgatgacaaaggaatcctaagacaaattactctgaatgatcttcctgtg

SEQ ID NO: 7004 - DNA, 60 bp, Homo sapiens
aatatccctactgacagtaactacctgtcacatatttctcttaggacttttaaagatgag

SEQ ID NO: 7005 - DNA, 60 bp, Homo sapiens
cattgagatggaactctccaagtacctgcgggattactcaaggactattccaggaaaaca

SEQ ID NO: 7006 - DNA, 60 bp, Homo sapiens
gtggtaaacactcgataatctggataactgactagcaccattatgatcaccagtattgtg

SEQ ID NO: 7007 - DNA, 60 bp, Homo sapiens
tgccgtgtcattttccatacaaatcagttgatttaaaggagttcatttcgcatactgggc

SEQ ID NO: 7008 - DNA, 60 bp, Homo sapiens
cgatagtccaaaaactgaagaagatggtggataagcccacccagagaagtgtttccaatg

SEQ ID NO: 7009 - DNA, 60 bp, Homo sapiens
gcatcagccctttatcctcacacgcttttctacaatggcattcaataaagtgtatatgtt

SEQ ID NO: 7010 - DNA, 60 bp, Homo sapiens
ggtcccagtgaatgaaaacgacatgaaggtagatgaagtcctttacgaagactcgtcaac

SEQ ID NO: 7011 - DNA, 60 bp, Homo sapiens
ttgaactcccagctaaacaaccaagacttcactgaagatttattccaattctagaattgt

SEQ ID NO: 7012 - DNA, 60 bp, Homo sapiens
catctgcgcataaaggaccagatgaaactctgaggattaaagctgagtatgaaggggatg

SEQ ID NO: 7013 - DNA, 60 bp, Homo sapiens
agtggttccagggccctgaccagtaggtgctcaataaatgtttgttgttgaatgaaaaaa

SEQ ID NO: 7014 - DNA, 60 bp, Homo sapiens
tcttaagagcctttctaagaacatgataggcttacttctgctccataataaagtgggaga

SEQ ID NO: 7015 - DNA, 60 bp, Homo sapiens
ctgacaaggagttagaaaaactagatgacattgttcagcatatttataagaccctgctct

SEQ ID NO: 7016 - DNA, 60 bp, Homo sapiens
ctaaccaggaaaaatgtgatagcacatgggtagcctaggcagtgagtaaatacctcagat

SEQ ID NO: 7017 - DNA, 60 bp, Homo sapiens
aactgtagggaacaccatttatgcagtggaggattcgatggcaatgaatttctgaatacg

SEQ ID NO: 7018 - DNA, 60 bp, Homo sapiens
gagctgtacagagaagcacctattgataaaaaggggaatttcaattacatcgagttcaca

SEQ ID NO: 7019 - DNA, 60 bp, Homo sapiens
gagattgccccaatgtacagaattatataattctaacgcttaaatcatgtgaaagggttg

SEQ ID NO: 7020 - DNA, 60 bp, Homo sapiens
tcaatgggtcacaatcccattggatggaaaggacttggctatgaacttgactggaaacac

SEQ ID NO: 7021 - DNA, 60 bp, Homo sapiens
ccacgaccagaggggccttctgaggaaagaggacctggtacttccagaatttctgcagct

SEQ ID NO: 7022 - DNA, 60 bp, Homo sapiens
aacatcagagaaaatgaaatatccacaaaacgtacatcaatcatttcacttacaccctgg

SEQ ID NO: 7023 - DNA, 60 bp, Homo sapiens
tttcaaaaagtatctgaagcaaattctcagactgaactacttcttagacctcactgtaag

SEQ ID NO: 7024 - DNA, 60 bp, Homo sapiens
aggaggcttgtcatactgtctagaggttgactcttagttctgtaaataaagacatccatt

SEQ ID NO: 7025 - DNA, 60 bp, Homo sapiens
tcaagtacatcgtccaaatccctgtctcttcagcttctctgatgcttgaactctcacctt

SEQ ID NO: 7026 - DNA, 60 bp, Homo sapiens
aggtgaagtttcagcctcttagcaaatatccggctgtgatcaatgatatttcattctggt

SEQ ID NO: 7027 - DNA, 60 bp, Homo sapiens
gaagactctttgaagacatcgtaacactgaaaagtacactttctactaaagatgcagaaa

SEQ ID NO: 7028 - DNA, 60 bp, Homo sapiens
ttcagatgaaacaagagttttccgcttattaggatcagacagggttgtcgttttggaaag

SEQ ID NO: 7029 - DNA, 60 bp, Homo sapiens
ttggataataagtgttctgtgtaccccttgacgtttgacaaaaatgaaaacatggctgcc

SEQ ID NO: 7030 - DNA, 60 bp, Homo sapiens
tccattaaagactgtgaaggtagaatgtttgtaaagctcttaacagtatgtaagccttca

SEQ ID NO: 7031 - DNA, 60 bp, Homo sapiens
ccgtgtaaccagtaactacagccatttacaattgactccgtttccttttgtaggtttccc

SEQ ID NO: 7032 - DNA, 60 bp, Homo sapiens
agaactgaattggctaggaaaaaagaaaaactgcatgttaatcattttcctaagctgtcc

SEQ ID NO: 7033 - DNA, 60 bp, Homo sapiens
ggcataaaacaggttcagaagaatcgacaatgatgtcatatttttccaagtaccaaattc

SEQ ID NO: 7034 - DNA, 60 bp, Homo sapiens
gataagtacaattggttgtccttgatttcataagtagaacaaacactaaatgtgcctctg

SEQ ID NO: 7035 - DNA, 60 bp, Homo sapiens
gtggaatggaagaaatgtcgatcctgttgtaactgattgtgaacacttttatgagcttta

SEQ ID NO: 7036 - DNA, 60 bp, Homo sapiens
aatcagtgatgctcgaagcgacctcctcgctgctattcgaatgggaattcaactgaaaaa

SEQ ID NO: 7037 - DNA, 60 bp, Homo sapiens
tctttttggttctttcttttctttttattaggttaagtctcaattctgaaggggaaaacc

SEQ ID NO: 7038 - DNA, 60 bp, Homo sapiens
tggaaaagctgttactagaaccaatgtttgaagtccctaattctgatatcgtatgtgtgg

SEQ ID NO: 7039 - DNA, 60 bp, Homo sapiens
acgaggaaacagtacagtcgctagtcaagtggtttttaaagtaaagtatattcataaggt

SEQ ID NO: 7040 - DNA, 60 bp, Homo sapiens
accccacccagcctggatctaccccaggagactctgggaacttttaggggtcactcaatt

SEQ ID NO: 7041 - DNA, 60 bp, Homo sapiens
tactgcgtctttgtttctatcagtctttgtagaagcaggtggtggtggaaattccagcag

SEQ ID NO: 7042 - DNA, 60 bp, Homo sapiens
acgtgtctttgagaattgccatcaaagttctcgactacgcgtacaaacacaacctggctt

SEQ ID NO: 7043 - DNA, 60 bp, Homo sapiens
ttattcgaagacacagaagttgggcaagtcaaatgttgtgtcgtcagttgtgcatccgtt

SEQ ID NO: 7044 - DNA, 60 bp, Homo sapiens
ttatgtggctaatgagtttctcaaatatcgtttacacgttggtaactataatggcacagc

SEQ ID NO: 7045 - DNA, 60 bp, Homo sapiens
tgctcaggccagttgcaatgtctgtcagtaacgaggcttttgatgtgttgagctggaggt

SEQ ID NO: 7046 - DNA, 60 bp, Homo sapiens
gactggtatcaaacagaatctcaagtagtcattacacttatgatcaagaatgttcagaag

SEQ ID NO: 7047 - DNA, 60 bp, Homo sapiens
tgctttttcaaaacggatccgggcaatgcttcgttttctaaaggatgctgctgttgaagc

SEQ ID NO: 7048 - DNA, 60 bp, Homo sapiens
atcccctctgaattatagaccgagtcttgttgtttagcctaagagaagatttatgtagta

SEQ ID NO: 7049 - DNA, 60 bp, Homo sapiens
cctacacaagtgatgtttatatttctcataaagagtcttccctatcccaaggtcttcatg

SEQ ID NO: 7050 - DNA, 60 bp, Homo sapiens
ctctgagttcaagattcatcttcagaatcctgtatactggacaaacgtaggaaatgttaa

SEQ ID NO: 7051 - DNA, 60 bp, Homo sapiens
ttggaaatatgaaagcaaatgtttagaagaattccttttgaaaagctgtgtcgtgttccc

SEQ ID NO: 7052 - DNA, 60 bp, Homo sapiens
cctactataataatgctgaatcttaatttagagggtacaagggtatggtaatgcttgtag

SEQ ID NO: 7053 - DNA, 60 bp, Homo sapiens
gtgagtgagactgagggatcgtagatttttacaatctgtatctttgacaattctgggtgc

SEQ ID NO: 7054 - DNA, 60 bp, Homo sapiens
aatattctgtgaagaaaagaggacttcagggagtaaaaaagccactgatgtctgtgtctg

SEQ ID NO: 7055 - DNA, 60 bp, Homo sapiens
gtgtatgtgcagttacacagtttcctgtatcataaatcctagtgtgtttatacaaggaga

SEQ ID NO: 7056 - DNA, 60 bp, Homo sapiens
aagaggtgaggcttactattcactatgaaaatgggttcaccatctcaagggaaaatggag

SEQ ID NO: 7057 - DNA, 60 bp, Homo sapiens
ggcttctgatgaatcttgcgttttttacaaattggagcagggacagatcatagatttctg

SEQ ID NO: 7058 - DNA, 60 bp, Homo sapiens
agtgagattgttgaacaaactgaatatatgggctatagcaagtagctttacagtacagat

SEQ ID NO: 7059 - DNA, 60 bp, Homo sapiens
tcagagttgactttcctcccattttaccactttaaacacccccataacaattcccccatc

SEQ ID NO: 7060 - DNA, 60 bp, Homo sapiens
tgatgcaagcatctaagagagaggttaatcacactatagaggcataagtggtatcagttt

SEQ ID NO: 7061 - DNA, 60 bp, Homo sapiens
tcaagcaaaaattcagccctgaaatcaggcacatctgttcgttggactaaacccacaggt

SEQ ID NO: 7062 - DNA, 60 bp, Homo sapiens
tggatttctaaactgctcaattttgactcaaaggtgctatttaccaaacactctccctac

SEQ ID NO: 7063 - DNA, 60 bp, Homo sapiens
aaaggtgaaagaggtgaaaactcagtgtccgtcaggattgtcggcagtagtaaccgaggc

SEQ ID NO: 7064 - DNA, 60 bp, Homo sapiens
gaggaatgatttcaaagacatagaggacattaaaaagcacaaggttcggatagaggggtc

SEQ ID NO: 7065 - DNA, 60 bp, Homo sapiens
taaaaatgcagtgtcatggatcttagagctaaaaaggactgtaaaaattacccagaacag

SEQ ID NO: 7066 - DNA, 60 bp, Homo sapiens
gctattccttggagaaggtatttgggattcaattgaaggaaattgataagaatgaccact

SEQ ID NO: 7067 - DNA, 60 bp, Homo sapiens
cacctgtgggaagagaagtgaagactttctccttgcattaaaaagtctgaactgtgaaaa

SEQ ID NO: 7068 - DNA, 60 bp, Homo sapiens
cctggtccagacagtcctctactgcgatttcttctacctctatatcaccaaagtcctaaa

SEQ ID NO: 7069 - DNA, 60 bp, Homo sapiens
gaaatctacttggatcccatgcctgaaatttggaagcatatgtacacaaatcatttttac

SEQ ID NO: 7070 - DNA, 60 bp, Homo sapiens
attggacttgagtatttatatattgtgcatcaactctgttggatacgagaacactgtaga

SEQ ID NO: 7071 - DNA, 60 bp, Homo sapiens
acatctcagagtttcctacgttgaagtattttaagaatggagagaaatacgcagtgcctg

SEQ ID NO: 7072 - DNA, 60 bp, Homo sapiens
tgtgaagcacccaccatgttcttgaacaatcaggtttctaaataaacaactggaccatca

SEQ ID NO: 7073 - DNA, 60 bp, Homo sapiens
atttgaggttatctgctacgaaacagtatttctaaaaggctaaagtgataagtctcttgc

SEQ ID NO: 7074 - DNA, 60 bp, Homo sapiens
tgctgtatgatactatttaaatttggaggacaacttatcttcactaagctgaatcaggtg

SEQ ID NO: 7075 - DNA, 60 bp, Homo sapiens
tgatgaatgctattaagaaatatcagaaaggcttctctgataaactggatttccttgagg

SEQ ID NO: 7076 - DNA, 60 bp, Homo sapiens
ttatgagatatctctcacttgtcttccactttgaaccggttaaagctcatagctgtcagc

SEQ ID NO: 7077 - DNA, 60 bp, Homo sapiens
gctcttaatgtattcctttttagtaggaatccggaagtattagattgaatggaaaagcac

SEQ ID NO: 7078 - DNA, 60 bp, Homo sapiens
tggatgtgacacctcataaaagtgagctttgaactgtagataactcttaaagaaaatgtc

SEQ ID NO: 7079 - DNA, 60 bp, Homo sapiens
gccatattcttacttgaatgctttgaatgactacatccagttctgcacctataccctctg

SEQ ID NO: 7080 - DNA, 60 bp, Homo sapiens
actcactagattctgcagtcaaagatgactaatatccttgcatttttgaaatgaagccac

SEQ ID NO: 7081 - DNA, 60 bp, Homo sapiens
tctggagtgatccatgaaggaccattaacatgtgatacctttcctctctattaatgttga

SEQ ID NO: 7082 - DNA, 60 bp, Homo sapiens
tgtgggactcacctgactcaaagatgactaatatcgtcccattttggaaataaagcaaca

SEQ ID NO: 7083 - DNA, 60 bp, Homo sapiens
gtctaaaatcaaagcgccaatctcataagtaccaggctgaattccccatgagtcctgtga

SEQ ID NO: 7084 - DNA, 60 bp, Homo sapiens
gtatgctggtcatttctagagacagcaatcaatatttgagtgtaaggaaactgtctgggg

SEQ ID NO: 7085 - DNA, 60 bp, Homo sapiens
tggttgagacaagtgcaaaaaatgctattaatatcgaagagctctttcaaggaatcagcc

SEQ ID NO: 7086 - DNA, 60 bp, Homo sapiens
gcccagccgtgtatttatttttcacctatctccttcctgtcaaggcaggccgggctccag

SEQ ID NO: 7087 - DNA, 60 bp, Homo sapiens
ggatggagctaagaagtctgaatacttaatgaaatggactttttggaaagaaatcagatg

SEQ ID NO: 7088 - DNA, 60 bp, Homo sapiens
agagttagacctctagactcacctgttctcacgccctgttttaatttaacccagctatgg

SEQ ID NO: 7089 - DNA, 60 bp, Homo sapiens
taacaccttttactcttcttactggtgctattttgtagaataaggaacaacgttgacaag

SEQ ID NO: 7090 - DNA, 60 bp, Homo sapiens
ctttggctttttcaccaccgtcttcaatgcccatgagcctttccgccggggtacaggtgt

SEQ ID NO: 7091 - DNA, 60 bp, Homo sapiens
gtactgattaaaccacactgagggaaacatccctcttagctgggaaactgtttactcttc

SEQ ID NO: 7092 - DNA, 60 bp, Homo sapiens
ggagagatatttgaagttgatgtggaaattgccaaacaatctgtaactattaagaccatg

SEQ ID NO: 7093 - DNA, 60 bp, Homo sapiens
aggttggcagtaaggcagggtcccatttctcactgagaagattgtgaatatttccatatg

SEQ ID NO: 7094 - DNA, 60 bp, Homo sapiens
atgctggtggactatgtgcccctggtggaggtggacgacatgatgatcatgggcaagaag

SEQ ID NO: 7095 - DNA, 60 bp, Homo sapiens
ccaagtgtggttacaaatgaacccatggaatgatgacttcatgttcttctcgtgggtttg

SEQ ID NO: 7096 - DNA, 60 bp, Homo sapiens
gtgcctcctttattaaggggttctttgagaataaaagagaaaagacctactttatttgac

SEQ ID NO: 7097 - DNA, 60 bp, Homo sapiens
ccttgcttctcaccccttgcctcccagtggtatttgaataaagtatgtagctataaaaaa

SEQ ID NO: 7098 - DNA, 60 bp, Homo sapiens
cagcagaaatatcctcctgtgacaccttccccaccctgccagccaaagtatccaccgaag

SEQ ID NO: 7099 - DNA, 60 bp, Homo sapiens
tgccaatgcgagaacgttcttactaccggggaagaaagaagggtaaaaagaaggatcaga

SEQ ID NO: 7100 - DNA, 60 bp, Homo sapiens
cttctcttcaggaggtttggcttggcatgaaaatacttcattcagagtatgggcaaatgc

SEQ ID NO: 7101 - DNA, 60 bp, Homo sapiens
ctgttccctgacaaagtttcaacaattgtaaatatttcttccttgaagaggagagcttgg

SEQ ID NO: 7102 - DNA, 60 bp, Homo sapiens
tgcatcacgtcctacacccaccgtgactacatggtgtccaacccatccctgatcaccaag

SEQ ID NO: 7103 - DNA, 60 bp, Homo sapiens
tctttgagagatcttctgttaatacacattggttgttaaagagtacccaaattctaggac

SEQ ID NO: 7104 - DNA, 60 bp, Homo sapiens
cacagtgcttgatatttcagagtcagtcattggttatacatgtgtagttccaaagcacat

SEQ ID NO: 7105 - DNA, 60 bp, Homo sapiens
aacagcaaactccctccagactttgtccatgttataaacttgaaagttggttgttgtttg

SEQ ID NO: 7106 - DNA, 60 bp, Homo sapiens
gcttggtcattatgaaccaggtgagcaatgcctacctataccgcaagaggatccaaccat

SEQ ID NO: 7107 - DNA, 60 bp, Homo sapiens
tcgccaacactacccaggactcttgctacctggttccaactccagacaaccactatgcca

SEQ ID NO: 7108 - DNA, 60 bp, Homo sapiens
caaaaggtgtttctcttctgctccctgaacctcttaacttaataaaacgttccagcagct

SEQ ID NO: 7109 - DNA, 60 bp, Homo sapiens
tttctttctcccaaagtggatccttccttaatggaagactcagatgacggtccttcgcta

SEQ ID NO: 7110 - DNA, 60 bp, Homo sapiens
acactggatggaagaaacatacctatgtcagtaaatgatattgtgaaacccggaatgagg

SEQ ID NO: 7111 - DNA, 60 bp, Homo sapiens
gagacaagaggaaagaaacaaagcatttattccacctaaggaaaaaccaattgtgaaacc

SEQ ID NO: 7112 - DNA, 60 bp, Homo sapiens
ctcgggattatcaggaaatgattgaaaactatgtccattggaatgaagacataggagaat

SEQ ID NO: 7113 - DNA, 60 bp, Homo sapiens
ggctcaagctgtgatgctgctggttttatctctagtgaaataaagtcaaaagttatttaa

SEQ ID NO: 7114 - DNA, 60 bp, Homo sapiens
tgtccactctggatgagaattggccacctgatggttatttatacgtccagaagaacatcc

SEQ ID NO: 7115 - DNA, 60 bp, Homo sapiens
tgggacatcttaggagataggccaagtctagttcattctagggacatgaaaatgggagtt

SEQ ID NO: 7116 - DNA, 60 bp, Homo sapiens
tagtgttgattttgctctcagatgaacacaatgtctcatactaaccaagaagcaagaaaa

SEQ ID NO: 7117 - DNA, 60 bp, Homo sapiens
tgctgtctgtgtcttctatttggcaaacagcaatgatcttccaataaaagatttcagatg

SEQ ID NO: 7118 - DNA, 60 bp, Homo sapiens
gtgttctagctcgagtggaagaactcattgaaataaaaacaaagtctacctctgaagaaa

SEQ ID NO: 7119 - DNA, 60 bp, Homo sapiens
agggtcagccattcacacccatccactcacctcccattcccagccacatggcagagaaaa

SEQ ID NO: 7120 - DNA, 60 bp, Homo sapiens
tgaacaatgctctttcattgaatataaggattttaagctgatatatcggcagtatgcagc

SEQ ID NO: 7121 - DNA, 60 bp, Homo sapiens
ataaaaggactctcagcctcttggcaatcataaatattaaagtcggtttatccaggcaaa

SEQ ID NO: 7122 - DNA, 60 bp, Homo sapiens
gcacacttgtatattgaaaagatagggaagagagaaacatttatggaatcagtcgttggc

SEQ ID NO: 7123 - DNA, 60 bp, Homo sapiens
agcagcggctgtacaaggatgaccaactcttggatgatggcaagacactgggcgagtgtg

SEQ ID NO: 7124 - DNA, 60 bp, Homo sapiens
aaaggatgatcaaaacacacagtgtttatgttggaatcttttggaactcctttgatctca

SEQ ID NO: 7125 - DNA, 60 bp, Homo sapiens
gcatatatgtatgtacatgtacatgtttttgaaacggattggaaggatacagaccaaact

SEQ ID NO: 7126 - DNA, 60 bp, Homo sapiens
atactagatggaagacttgcatcagttgcttaaactttcagaaaatttgtagagaaaccc

SEQ ID NO: 7127 - DNA, 60 bp, Homo sapiens
ggcaccaaggaggatccaagagctgactatgcctgcattgctgagaacaaacccacctga

SEQ ID NO: 7128 - DNA, 60 bp, Homo sapiens
agaaccctgcacccctcaatggagtaaattaccataaagcctcttccttacccatgcttt

SEQ ID NO: 7129 - DNA, 60 bp, Homo sapiens
agggaagaataacgttcttatcgtctgtgttccaaatccaccaattgacgagaagaatgc

SEQ ID NO: 7130 - DNA, 60 bp, Homo sapiens
gtaaagaagagggaatacatgataaagtaactggtttgatttctcgttcattgtacactg

SEQ ID NO: 7131 - DNA, 60 bp, Homo sapiens
tggctgagggacatgtactgcctctcatctagaatttattttcctagcacttcaccacct

SEQ ID NO: 7132 - DNA, 60 bp, Homo sapiens
agggcccatctgccttgtggcccacaatggctttgattatgatttccccctgctgtgtgc

SEQ ID NO: 7133 - DNA, 60 bp, Homo sapiens
atcataaccaccagaaatcatactctcctttcttagtcacaacaaaatcacacatgtcat

SEQ ID NO: 7134 - DNA, 60 bp, Homo sapiens
atctgtcagtatgggaggatataaactgcatcattagtgaaattattggttgtgtaatcc

SEQ ID NO: 7135 - DNA, 60 bp, Homo sapiens
ccccattacctagggacaagagtcttccccagccttgaacctaggaccaagagccaccta

SEQ ID NO: 7136 - DNA, 60 bp, Homo sapiens
gattacaacacctgctatcaaatcatctaagctgaaaacatgagatgcgcttggaaaggc

SEQ ID NO: 7137 - DNA, 60 bp, Homo sapiens
tgtgaccataggaccatttttcaaaatgcgctttcttcgtagaagaaatgttcagtttaa

SEQ ID NO: 7138 - DNA, 60 bp, Homo sapiens
gggcagtgggttgtaaatactttttaaaaaacactaagttccttatctcagatgctgttc

SEQ ID NO: 7139 - DNA, 60 bp, Homo sapiens
aaatcacttgatgtaacctggaaactatgctttacatggcaatcaaagccttttgatcat

SEQ ID NO: 7140 - DNA, 60 bp, Homo sapiens
ctatccctggccacacctggcgagtaggccaagaaggaaaatctgacgaataaagacccc

SEQ ID NO: 7141 - DNA, 60 bp, Homo sapiens
ctgtgggtagtggggagggctgaacaggacaacctctcatcacccccacttttgttcctt

SEQ ID NO: 7142 - DNA, 60 bp, Homo sapiens
acctacacaccaaagctttatttatatcattccagtatcaatgctacacagtgttgtccc

SEQ ID NO: 7143 - DNA, 60 bp, Homo sapiens
agtgccacaatgggtcagctgtaccaggaacaccatgaagaagacttctttctctacatt

SEQ ID NO: 7144 - DNA, 60 bp, Homo sapiens
ggggtcactgcagtttgggatggttgaatgctgtattttctaaagaataaaatattttta

SEQ ID NO: 7145 - DNA, 60 bp, Homo sapiens
tgcttagagcatgttcttggaacatggaattttataagctgaataaagtttttgacttcc

SEQ ID NO: 7146 - DNA, 60 bp, Homo sapiens
actccgccttttcaaatttttgtataaccccgtgttgtgtaaatacagtttttgctccgg

SEQ ID NO: 7147 - DNA, 60 bp, Homo sapiens
cacagcaaatgagatgtatgcccaaagcggtagaattaaagaagagtaaaatggctgttg

SEQ ID NO: 7148 - DNA, 60 bp, Homo sapiens
atcatattgatgagcgaacaaacaagaacatttcctccctcccctcctttgaattgaaat

SEQ ID NO: 7149 - DNA, 60 bp, Homo sapiens
cagagaaggtggagagtaaagacccaacattactaacaatgatacagttgcatgttatat

SEQ ID NO: 7150 - DNA, 60 bp, Homo sapiens
ttttcttagtctgatgccaagcaaggccttttctgaataaattcatttgactttgaaaaa

SEQ ID NO: 7151 - DNA, 60 bp, Homo sapiens
ggtgctgttttaatttctaaaggtaggaccaacacccaggggatcagtgaaggaagagaa

SEQ ID NO: 7152 - DNA, 60 bp, Homo sapiens
ttgttcttagataacccacattagatgaatgtgttaagtgaaatgatacttgtactcccc

SEQ ID NO: 7153 - DNA, 60 bp, Homo sapiens
ggagactgtttggaaattgattttgaacctgatgaaaataaagaatggaaagcttcagtg

SEQ ID NO: 7154 - DNA, 60 bp, Homo sapiens
gttgactcaaaacttgctagttactgcctacctgagtagaatcttatttatgaactcctg

SEQ ID NO: 7155 - DNA, 60 bp, Homo sapiens
agatgaagaaagagactgtggggaggggcatgtacttctttattttttaacttatgtatg

SEQ ID NO: 7156 - DNA, 60 bp, Homo sapiens
tcggacagccaatagccgtcctcatgtacgtccacgactactacgtgctcaactatgagg

SEQ ID NO: 7157 - DNA, 60 bp, Homo sapiens
ctatgtcaatgccattgaaaaagtcttcaaagtgtacagtgaagctggtgtgaccttcac

SEQ ID NO: 7158 - DNA, 60 bp, Homo sapiens
aacttgaccagttagacttacgaagagatattgcctacaacttgtctctcatctatcaga

SEQ ID NO: 7159 - DNA, 60 bp, Homo sapiens
ttttcagaaagcaaacaacacaattacaaggttgaatctgaggaaaataatccttgtgcc

SEQ ID NO: 7160 - DNA, 60 bp, Homo sapiens
ccctgcaattggaatgttggccagatttctgcaataaacacttgtggtttgcggaaaaaa

SEQ ID NO: 7161 - DNA, 60 bp, Homo sapiens
ttctctaagccataatctcttagtggattgagccctcttggaaagacttctctgccatcc

SEQ ID NO: 7162 - DNA, 60 bp, Homo sapiens
ccaacagcagtttctctagttctaaattttaccaattcccaaaaaacctaagttttgctg

SEQ ID NO: 7163 - DNA, 60 bp, Homo sapiens
atggtcatcaaagacagcccacaaaccatcccaacatacacagatgccttgcacgtttat

SEQ ID NO: 7164 - DNA, 60 bp, Homo sapiens
tgtgggatgattacttttttaaggaggattaattctgaggtagtatagtaactaaagggg

SEQ ID NO: 7165 - DNA, 60 bp, Homo sapiens
aaagggctctggatggagtgtgtgtggcacagcacaggcatctaccagtgccagatctac

SEQ ID NO: 7166 - DNA, 60 bp, Homo sapiens
gatagttggatccctttacttattaatgccattgatcattgcatgaatagaatcaaggag

SEQ ID NO: 7167 - DNA, 60 bp, Homo sapiens
atctgagcagaaaaattcaagtataaaaacttcagatagtcacagtaatccccactcttc

SEQ ID NO: 7168 - DNA, 60 bp, Homo sapiens
tttgcatcagtcacgttaaccagatgactttgcctgttaccaaacctcatgcatccacgt

SEQ ID NO: 7169 - DNA, 60 bp, Homo sapiens
gtcgagggtagataggccttaacttagtccatagcgtcctcaccttccccaagccacaca

SEQ ID NO: 7170 - DNA, 60 bp, Homo sapiens
atctacaagttcatcaccgagggcttccccttctacccggacaaccccaaaaagtggcag

SEQ ID NO: 7171 - DNA, 60 bp, Homo sapiens
gtctgtgaagaagaaaattatctccctagttcaatctgtagtgaaataagactacagaag

SEQ ID NO: 7172 - DNA, 60 bp, Homo sapiens
gtgattctctgaggaaagagtgattctgatatatgtacttgtcacattggtgttggacac

SEQ ID NO: 7173 - DNA, 60 bp, Homo sapiens
ccaaagacaaacgattagaagatggctatttcagaataggaaaatttgagaatggtgttg

SEQ ID NO: 7174 - DNA, 60 bp, Homo sapiens
gtgtttcagtttttataagtgaagattttattttaaaaaccagtgggaaagagtgggggg

SEQ ID NO: 7175 - DNA, 60 bp, Homo sapiens
ccctcaatttcgcacaattcacttgaatgacttgttttatttgcaataaaactgggctga

SEQ ID NO: 7176 - DNA, 60 bp, Homo sapiens
cccaagtcgaaatcacctcttgttttaaacaagaatgaatcattactgtgtatgttaggg

SEQ ID NO: 7177 - DNA, 60 bp, Homo sapiens
agcacagctactcacgctgccatctggacttattttatgtcaatctgtttataaataaaa

SEQ ID NO: 7178 - DNA, 60 bp, Homo sapiens
tttatcacaaatcgggattctctcccccaccccgaattctgtctgcttaaactggaatac

SEQ ID NO: 7179 - DNA, 60 bp, Homo sapiens
ttctcagagtaaaggatcgtgatgagttcccaatgattttaattggtaataaagcagatc

SEQ ID NO: 7180 - DNA, 60 bp, Homo sapiens
aatacagtggatctgaatttattaatgcttataaacacatttgaggaataggaggtccgg

SEQ ID NO: 7181 - DNA, 60 bp, Homo sapiens
gagtggtcaattgagtagtacagtggaaactgttaaatgcataacctaattttcctggga

SEQ ID NO: 7182 - DNA, 60 bp, Homo sapiens
ttgagaatcaaagggatctgcatttagcaatgtgatgtcagtaaatggacataacaggat

SEQ ID NO: 7183 - DNA, 60 bp, Homo sapiens
gggtgtatcaccccagtacttccaaatgcctctcctctattgattcagttgttattgcag

SEQ ID NO: 7184 - DNA, 60 bp, Homo sapiens
aagctccttttctcatttcaaagttgctaccagtgtatgcagtaattagaacaaagaaga

SEQ ID NO: 7185 - DNA, 60 bp, Homo sapiens
agttgttcatgttgcagaaaaaggttatacgtaccacggattctctttaatattgtacag

SEQ ID NO: 7186 - DNA, 60 bp, Homo sapiens
aagctgaagtcagccatcctttctgcccagtctgctgccaacgtgaggaaggagagccta

SEQ ID NO: 7187 - DNA, 60 bp, Homo sapiens
tagaactctctgattttgatgaattatatgggagtgagaaacagaagaagtggtatttgc

SEQ ID NO: 7188 - DNA, 60 bp, Homo sapiens
gtgcacaaagtacaaaggaatttatacagattgggtttaccgaagtataatctataggag

SEQ ID NO: 7189 - DNA, 60 bp, Homo sapiens
gaaattggagctctgtacaaactgaaaaagacaaaataagtaaagcacttgttgctttgc

SEQ ID NO: 7190 - DNA, 60 bp, Homo sapiens
atgacctctgcaaacagaatcttggatatttcttctgaaggattatttgcacagacttaa

SEQ ID NO: 7191 - DNA, 60 bp, Homo sapiens
gttagagaatcctatcagaagtaaatattaaggatcaagctgttagctaataatgccacc

SEQ ID NO: 7192 - DNA, 60 bp, Homo sapiens
ggttcaacaaactcatctggatacatcattcttgtcacattacttacaaatcaactggtg

SEQ ID NO: 7193 - DNA, 60 bp, Homo sapiens
gggccacaaagatatagtggaaatgctatttactcaaccaaatattgaactgaaccagca

SEQ ID NO: 7194 - DNA, 60 bp, Homo sapiens
caggtcccacgtttcctcccccttttttcttgggaaatatatttttccatctgttgctta

SEQ ID NO: 7195 - DNA, 60 bp, Homo sapiens
cccaacatggtcctagcactgcacactcagttctgctctaagaagctgcaataaagtttt

SEQ ID NO: 7196 - DNA, 60 bp, Homo sapiens
ggaccactggctcctcctcctccaccacgttttccttttggaacaggatttgttccacca

SEQ ID NO: 7197 - DNA, 60 bp, Homo sapiens
gtcaaacgagcccattttctccaaagtggaatctgaccaagcatgagagagatctgtcta

SEQ ID NO: 7198 - DNA, 60 bp, Homo sapiens
gccatctctgtttcccctgttttcccacatactaggtgctcaattcatgcctgtgaatgg

SEQ ID NO: 7199 - DNA, 60 bp, Homo sapiens
tcaatctcagacttaccaaagttaaagttgagaaagcttgaactaagagtctcagggggc

SEQ ID NO: 7200 - DNA, 60 bp, Homo sapiens
gccaactgcatggcatggatttattggtcttattggatttgattggagctccaaacccaa

SEQ ID NO: 7201 - DNA, 60 bp, Homo sapiens
acctcctgatacctttgcttaattaaactagatgataattctcaggtactgataaacacc

SEQ ID NO: 7202 - DNA, 60 bp, Homo sapiens
cggaagcgtcagtgtttccatgttatggatctctctgcgtttgaataaagactatctctg

SEQ ID NO: 7203 - DNA, 60 bp, Homo sapiens
aggtgaactcagatgttatggttttgtatatgtctgcaatcatggataggaataaaatcg

SEQ ID NO: 7204 - DNA, 60 bp, Homo sapiens
tcgggagacttttctgtgctcctttctacacatgccttaaaccttccttcctgtggggtg

SEQ ID NO: 7205 - DNA, 60 bp, Homo sapiens
aggtcttattgttcagtgaaataataagatgcaacatttgttgaggccttatgattcagc

SEQ ID NO: 7206 - DNA, 60 bp, Homo sapiens
ccaaatttgttcctttctcattcagtctactttcatcaaagttcaataacgacgacagtg

SEQ ID NO: 7207 - DNA, 60 bp, Homo sapiens
tagtccaaaaactgaagaagatggtggataagcccacccagagaagtgtttccaatgctg

SEQ ID NO: 7208 - DNA, 60 bp, Homo sapiens
tcacttggtcctacctattatccttctacttgtccagttcaaataagaaataaggacaag

SEQ ID NO: 7209 - DNA, 60 bp, Homo sapiens
aagtcagtatcatattattatcctcctgttctgaaaccttagtttcaagagtctaaaccc

SEQ ID NO: 7210 - DNA, 60 bp, Homo sapiens
aagccactgactgttataaagtataacaacacacatcaggttttaaaaagccttgaatgg

SEQ ID NO: 7211 - DNA, 60 bp, Homo sapiens
cctgcagacaatgaatgaagtgtgctcattgaaataaaatacagagtcaaatcgctattg

SEQ ID NO: 7212 - DNA, 60 bp, Homo sapiens
cctaagccatgaatgaactacatccaaatacctgaatttttggaatctgtttcatggatt

SEQ ID NO: 7213 - DNA, 60 bp, Homo sapiens
atccatgcaaattgtcgcatccgacgggtttacttctcagacagactctactcagaagat

SEQ ID NO: 7214 - DNA, 60 bp, Homo sapiens
tccttgagtgagttttttgaaatgttgccttccagcgagttccaaatcagcgtggtagac

SEQ ID NO: 7215 - DNA, 60 bp, Homo sapiens
ctaagcacaaaaataaaaacttatcactgtataccactggagttttctggttatctctcg

SEQ ID NO: 7216 - DNA, 60 bp, Homo sapiens
atcccaccaaatcatcctgaatctgatctttttatacacaatatacgaaaagccagcttg

SEQ ID NO: 7217 - DNA, 60 bp, Homo sapiens
ctacgaaaaagaaatagttagtcaccttctgaccttctcctctttctcaaagccttctgt

SEQ ID NO: 7218 - DNA, 60 bp, Homo sapiens
taacctggaagaccatgagtggtgtgaaaacatggagtccgttttatagtgactaaagga

SEQ ID NO: 7219 - DNA, 60 bp, Homo sapiens
gttggtgtgcgctactatgaaacacacaacgtgaaaaataggaacaggaacaaaaagaag

SEQ ID NO: 7220 - DNA, 60 bp, Homo sapiens
tttgaccaactgtatggaaagttgtcagtaaaacctttgacgagagatggatttttaaac

SEQ ID NO: 7221 - DNA, 60 bp, Homo sapiens
ttgcttacaaatgtctaggtccccactgcctgctggaaagaaaacacactcctttgctta

SEQ ID NO: 7222 - DNA, 60 bp, Homo sapiens
aatgctttgttggagtttaaaaattcagggaaaaaatcggcagaccattagttactatgg

SEQ ID NO: 7223 - DNA, 60 bp, Homo sapiens
gggagaacatctgatgttaacttgacagtcttgtctcgtgtattgaattcgtgccaaagg

SEQ ID NO: 7224 - DNA, 60 bp, Homo sapiens
cccaactccgcgtgagacagagaattattcagataatttaaattaaaaaacgacgtgaaa

SEQ ID NO: 7225 - DNA, 60 bp, Homo sapiens
ctgcctcaggagactctgattttatatttgagaaaaataaaggcgttcaatctgcaaaaa

SEQ ID NO: 7226 - DNA, 60 bp, Homo sapiens
ttagaatatattaaagtcagagtctctgaggaaggaatgtgatttggcagtcagggtact

SEQ ID NO: 7227 - DNA, 60 bp, Homo sapiens
ctgttactgtctcttctggttataaagcagacatgtggccatcttttccgcagggttaga

SEQ ID NO: 7228 - DNA, 60 bp, Homo sapiens
tggcagcaaacctgcctatgcattcatggctctggacgcattggctgatggtggggtgaa

SEQ ID NO: 7229 - DNA, 60 bp, Homo sapiens
tgcagatgttcaatatggatcgggttaatgttgaggaattctatgaagtttataaaggag

SEQ ID NO: 7230 - DNA, 60 bp, Homo sapiens
ctccaaattgtagaagcttttcaggaaccatattactctcatgatacttcattaatctcc

SEQ ID NO: 7231 - DNA, 60 bp, Homo sapiens
atgtgtgttaatccctgatccaaaaagaacaaatacacgtatgttataaccatcagcccg

SEQ ID NO: 7232 - DNA, 60 bp, Homo sapiens
tttcatagcggttacgactttggctacttaatcaaaatcctaaccaactctaacttgcct

SEQ ID NO: 7233 - DNA, 60 bp, Homo sapiens
ctggatgccttaaaaaataagcaatgttaacagtgaactgtgtccatttaagctgtattc

SEQ ID NO: 7234 - DNA, 60 bp, Homo sapiens
gtcctgctcatccaaccacccctaaatacccaccctgtggactttgagctgaacatgccc

SEQ ID NO: 7235 - DNA, 60 bp, Homo sapiens
atctattccaaatgccttaacgagactctgtttctgggagtctgattttccacttacaca

SEQ ID NO: 7236 - DNA, 60 bp, Homo sapiens
aactggacagctgagtgtcataaactctaaaatagtccaggctatagtaatattttttgg

SEQ ID NO: 7237 - DNA, 60 bp, Homo sapiens
tacaattttgaaatattaactgagcctcaaaatcaccctttctgtcaagcatatcttggc

SEQ ID NO: 7238 - DNA, 60 bp, Homo sapiens
gacttctctgctagaagagaccttgaacaagttcaattttgccaggaacagtaccctcaa

SEQ ID NO: 7239 - DNA, 60 bp, Homo sapiens
tatctactgttcatcctatttaggtatgaaaaaggctgtaaacactcctaaaaagctgag

SEQ ID NO: 7240 - DNA, 60 bp, Homo sapiens
cccctctgtccccatcttgtatgtgaaaacttgtctcaataaaccctttggagtaaaaaa

SEQ ID NO: 7241 - DNA, 60 bp, Homo sapiens
gctatagttaggaatacacaagcggtaaaatcgagtccttacagccataccacaaggtac

SEQ ID NO: 7242 - DNA, 60 bp, Homo sapiens
tggagctgaatttcaaagctggagatgtgatcttcctcctcagtcggatcaacaaagact

SEQ ID NO: 7243 - DNA, 60 bp, Homo sapiens
ggacaaggctgacaagcaatccagggacaagatactcaccaggaccaggaaggggactct

SEQ ID NO: 7244 - DNA, 60 bp, Homo sapiens
tgttcaataatgaaatggacgacttcagctctcccagcatcaccaacgagtttggggtac

SEQ ID NO: 7245 - DNA, 60 bp, Homo sapiens
gaatgaaggacaaaatacagatcccaagctaaatcccaaggatgacggcatcgtctatgc

SEQ ID NO: 7246 - DNA, 60 bp, Homo sapiens
aaatccccttctccttctattacccctgggagttagccatagttcccaacgtgagaatat

SEQ ID NO: 7247 - DNA, 60 bp, Homo sapiens
ctcccataaacagaccctaatatgcattttgatttgtaattggaaatgtaactttccctg

SEQ ID NO: 7248 - DNA, 60 bp, Homo sapiens
ctacatggatgagtcttccgctatagcacagtttagaaaaggtgtttatgtcttaattaa

SEQ ID NO: 7249 - DNA, 60 bp, Homo sapiens
tttccacctcgccttctgtggacacaaggagatccaccattttgcttgccatgtgccacc

SEQ ID NO: 7250 - DNA, 60 bp, Homo sapiens
cctcaagccgtaatgttgaacagaattggagtattttctttataatttcttgaacaggca

SEQ ID NO: 7251 - DNA, 60 bp, Homo sapiens
gaggcctggcgcttccccaactccagcttgctgagttccccatattattacagttccaca

SEQ ID NO: 7252 - DNA, 60 bp, Homo sapiens
ccaggctgtctagtgtaattgctaaccaagaccctattgctgtataaaacctaaataaac

SEQ ID NO: 7253 - DNA, 60 bp, Homo sapiens
gatccactgggtgaatcctccctctcagaaccaataaaatagaattgaccttttaaaaaa

SEQ ID NO: 7254 - DNA, 60 bp, Homo sapiens
tgccacagctgaagtcagtttgtcttgctggtttaaatagatctttcagagctgggtgct

SEQ ID NO: 7255 - DNA, 60 bp, Homo sapiens
cttgctacggtcctctatattgtgaaaaagcggctctttccatttttgtgagatcccaaa

SEQ ID NO: 7256 - DNA, 60 bp, Homo sapiens
ctatgcctcccccagccacaccaaaggcgagcaggaagtgaatactctggcaatgcctat

SEQ ID NO: 7257 - DNA, 60 bp, Homo sapiens
tggataatgtgtataagaatgtaggccttaactatttcacatgagtcaaaacaaagcagc

SEQ ID NO: 7258 - DNA, 60 bp, Homo sapiens
ctgtgtgttagttcccaacatcgaatgtgtacaacttaagttggtcctttacactcaggc

SEQ ID NO: 7259 - DNA, 60 bp, Homo sapiens
ataaatgcccaaaatgtagaactttaaccaaagacttgtcccttttaaagcaaaatgggg

SEQ ID NO: 7260 - DNA, 60 bp, Homo sapiens
tgtggagaatgatctgtacatagattttggtggaaagtttcattgtgtatgtagaagacc

SEQ ID NO: 7261 - DNA, 60 bp, Homo sapiens
aacaaatttaattttctacgcctctggggatatctgctcagccaatggaaaatctgggtt

SEQ ID NO: 7262 - DNA, 60 bp, Homo sapiens
gtgggtgggctgtcaagacgtgtcatgtacatttgtatcaaaaataaagaagtgaccatg

SEQ ID NO: 7263 - DNA, 60 bp, Homo sapiens
caaggagtcaagtagatctgaaattaaatactcaacagactcctccttttttagctgtat

SEQ ID NO: 7264 - DNA, 60 bp, Homo sapiens
ccttgattgccaggtctggtctaagtttctttaataaagacaaaggagtgattttcaaaa

SEQ ID NO: 7265 - DNA, 60 bp, Homo sapiens
agaaatgtgcctcatttgccatttgagaaaatgcagtctggtgtattcagtaatatatag

SEQ ID NO: 7266 - DNA, 60 bp, Homo sapiens
atactcatgtctcaagtaagcttaaactacaacttgtcacataaaggaagtcttaagtgg

SEQ ID NO: 7267 - DNA, 60 bp, Homo sapiens
aacaaaaatgtgcagttaatacttggcgcttgaaaatgcagtagtgaatgtggaaccaag

SEQ ID NO: 7268 - DNA, 60 bp, Homo sapiens
tcactggcgtcttctgagttttatgagacaggaaactaagtttactatctgtaaatgtaa

SEQ ID NO: 7269 - DNA, 60 bp, Homo sapiens
atacagaaggctatcacacttgtgaaattctcttgtctaatctgaatttgcattccatgg

SEQ ID NO: 7270 - DNA, 60 bp, Homo sapiens
tattgaaccatggcttaatcaaatcatgcctaagaaagatcctgtcaaaatagtccgatg

SEQ ID NO: 7271 - DNA, 60 bp, Homo sapiens
tgtaaaagagagtcacaggtaccccaaggagtagatgccagggtcctaagttgaaaatga

SEQ ID NO: 7272 - DNA, 60 bp, Homo sapiens
catttaattaaataggccaaatttttgctgcttaggtcatctcaaggctgatacttgagc

SEQ ID NO: 7273 - DNA, 60 bp, Homo sapiens
gacacagagatctcctttgaccccgagaacctcatcacgggcatcgaggtgatcgacgaa

SEQ ID NO: 7274 - DNA, 60 bp, Homo sapiens
tgaaactttcttctgatgagtttctttaacgtacaggatggagtaaaacaaatggtacag

SEQ ID NO: 7275 - DNA, 60 bp, Homo sapiens
aggctgaaacatcccctccatactcagctctttaacttttcttttcctttttcatcgggc

SEQ ID NO: 7276 - DNA, 60 bp, Homo sapiens
acaagagatgcggagtatgtgggggctcattatcctgcatagtctatctttgtatatctt

SEQ ID NO: 7277 - DNA, 60 bp, Homo sapiens
aatttccattgtagaagcattgacacttctcaataatcataagcttttcccagaaacctg

SEQ ID NO: 7278 - DNA, 60 bp, Homo sapiens
tagtggatagcgttgttggaattcaaaaaacagacaatattgccatagaaatgtgtgaag

SEQ ID NO: 7279 - DNA, 60 bp, Homo sapiens
ggttatatcttacctgatatcactaaagatgaactcttcaaaatgctctgtactaggaag

SEQ ID NO: 7280 - DNA, 60 bp, Homo sapiens
ctcccattgactcaatcatgacaatatttctgctttaacaccatctttcgtgattagaaa

SEQ ID NO: 7281 - DNA, 60 bp, Homo sapiens
atcgttcacactctatgatgaggagattcagactccacagtgtatatattttgccattta

SEQ ID NO: 7282 - DNA, 60 bp, Homo sapiens
tataccaagtatgatgctgcgcacttcctcatcaacacagcctcattgctaagtgtactg

SEQ ID NO: 7283 - DNA, 60 bp, Homo sapiens
gacttcttaaatcatccttagaaccgtgaccatagcagtatatattttcctcttggaaca

SEQ ID NO: 7284 - DNA, 60 bp, Homo sapiens
catggttcatgccctggttgactgcctgggggaatttgtacgcaagaccttggctacctg

SEQ ID NO: 7285 - DNA, 60 bp, Homo sapiens
aaggaagctcacagctgggcgagtgcattttgaatagttttttgtaagtagtgcttttcc

SEQ ID NO: 7286 - DNA, 60 bp, Homo sapiens
ccccagaatataaatctcaggtaataaggctttagaactgctgataaagcggatcgttct

SEQ ID NO: 7287 - DNA, 60 bp, Homo sapiens
aactaaccacgtttacacgacttgagttttgaaccccgattaatgtctgtacgtcacctt

SEQ ID NO: 7288 - DNA, 60 bp, Homo sapiens
gcagcaaatagcaaatgaaaaagtcagctacaaaagttaatgaatatgccatctatgcag

SEQ ID NO: 7289 - DNA, 60 bp, Homo sapiens
cagaggccatggaaacattctttgcatttaagagacagatttatccctgtggagagtggg

SEQ ID NO: 7290 - DNA, 60 bp, Homo sapiens
gtggacgtcaaatactttgcccaggaggctctgactgttctgtctctcgcctgatgctgg

SEQ ID NO: 7291 - DNA, 60 bp, Homo sapiens
aagatgatgatcatgctgggagccatctgtgccatcatcgtggtagttattgtaatctac

SEQ ID NO: 7292 - DNA, 60 bp, Homo sapiens
gaactgattgaggaagggtctattgtctttttaaatggcacaattttaagggtttgaggg

SEQ ID NO: 7293 - DNA, 60 bp, Homo sapiens
ggttcagtagtgtgttaaacataacactgaataccttactgggatacagatttttgctca

SEQ ID NO: 7294 - DNA, 60 bp, Homo sapiens
tgcaaacaaggtgctttttccagaataaccaagattacctgagtccaagttttaataaca

SEQ ID NO: 7295 - DNA, 60 bp, Homo sapiens
ctggatgtataacatgaagctgaaaggaagaataaggatatgttagaactatcttatggg

SEQ ID NO: 7296 - DNA, 60 bp, Homo sapiens
aaggaaagagctccaaattgaatcacctttataatttacccatttctatacaacaggcag

SEQ ID NO: 7297 - DNA, 60 bp, Homo sapiens
tctgtactccaggcagaaatataacttgaaaatactgtgtctaaagaaatttcagtggtc

SEQ ID NO: 7298 - DNA, 60 bp, Homo sapiens
gctgccattctcaataatgcccattacctggaaaacctacattttaccatagaggggagg

SEQ ID NO: 7299 - DNA, 60 bp, Homo sapiens
ggcaagttggtcaatgctgcatgatgagaggccatatttatgtaatttcttaggaacgat

SEQ ID NO: 7300 - DNA, 60 bp, Homo sapiens
aaatctatgactcccaatatcttctagaataaagaattttccctctttaacacaagggcc

SEQ ID NO: 7301 - DNA, 60 bp, Homo sapiens
aacttcgtggatagtttgtggaaatcatccaattaaacatactgcttaaaacagtgttgc

SEQ ID NO: 7302 - DNA, 60 bp, Homo sapiens
actctgtcttgtacgtttgttctgctgctcttcaatattgtatcaacgccaggaaagggg

SEQ ID NO: 7303 - DNA, 60 bp, Homo sapiens
tcaaaatcatgggcaacctgaacttgcctaaacctcagcagatagactttgctgttccag

SEQ ID NO: 7304 - DNA, 60 bp, Homo sapiens
ttagggatgggtagatgtcaaactgccttacgcagtcatactgatctttagccatcagat

SEQ ID NO: 7305 - DNA, 60 bp, Homo sapiens
ttgctgatgtagacaagagttaactgagtagcatgctttattaagcatgagaaagaatct

SEQ ID NO: 7306 - DNA, 60 bp, Homo sapiens
gacttaggaaaacaatataaaggacatcctcatcatcacggggtgaaggtcagagtaagg

SEQ ID NO: 7307 - DNA, 60 bp, Homo sapiens
cctcagtgggaggcgtggctgagaccaactggtttgcctataatttattaactatttatt

SEQ ID NO: 7308 - DNA, 60 bp, Homo sapiens
aggctacattttcagtgtaagataaatggatgagtaaactcaaatatgtatcacgtgtgc

SEQ ID NO: 7309 - DNA, 60 bp, Homo sapiens
caggcatccctcctaacttttctttgtgcagcggtctggttatcgtctatccccagggga

SEQ ID NO: 7310 - DNA, 60 bp, Homo sapiens
ggcagatcagtgtctctagtcctacccagttttaaagttcatggtaagatttgacctcat

SEQ ID NO: 7311 - DNA, 60 bp, Homo sapiens
ggacggtgtccccgcacgtttgtattgtgtataaatacattcattaataaatgcatattg

SEQ ID NO: 7312 - DNA, 60 bp, Homo sapiens
agaaaggtaacaatcttcattctacagatgaactcattgaaacaatttaggggaatgagg

SEQ ID NO: 7313 - DNA, 60 bp, Homo sapiens
ttaagaacctcctacagcctgatgcttaaccctttccatttcctctcattccattcatgg

SEQ ID NO: 7314 - DNA, 60 bp, Homo sapiens
gaagcccaaggaccacctccttcctgcctcattgtaataaaattccccacactgaaaaaa

SEQ ID NO: 7315 - DNA, 60 bp, Homo sapiens
gaaaattaccatacagagtctaagattgatcgagacaagtcttttatacttgaggaacac

SEQ ID NO: 7316 - DNA, 60 bp, Homo sapiens
gaggatgatgcttatgacttcagtacagattatgtgtaacagaacaatggctttttatga

SEQ ID NO: 7317 - DNA, 60 bp, Homo sapiens
tgtcacaagcttaatttaaaagacattggattacctttggatccatttgtcaactggaag

SEQ ID NO: 7318 - DNA, 60 bp, Homo sapiens
tttttcaagcttcacatttgcgtgtatctaattcagctgatgctcaagtccaaggggtag

SEQ ID NO: 7319 - DNA, 60 bp, Homo sapiens
tttgaagtctaaaagactgcatttttaaacaagttagtattaatgcgttggcccacgtag

SEQ ID NO: 7320 - DNA, 60 bp, Homo sapiens
tgtcccatcccaagccatcacactccacaaaaacatttaatttatggatcctgcctcctg

SEQ ID NO: 7321 - DNA, 60 bp, Homo sapiens
agttgtagtgaattgctactgaaagctatcccaggtgatacagagctctttgtaaaccgc

SEQ ID NO: 7322 - DNA, 60 bp, Homo sapiens
gctttcacctcagtctgtacagttggaaatgagaattcataattaacagcaaaatctaag

SEQ ID NO: 7323 - DNA, 60 bp, Homo sapiens
gaggggagagaaatatctacaggtatatatggaaacaaataatgtggtctgctttataag

SEQ ID NO: 7324 - DNA, 60 bp, Homo sapiens
ctcacatcccaagtctatacccttacctgaagaatgctgttctttcctagccacctttct

SEQ ID NO: 7325 - DNA, 60 bp, Homo sapiens
agagcagcctcttcctctcctggtcccagaaaaacccttgcagtaaatggtggcctctgg

SEQ ID NO: 7326 - DNA, 60 bp, Homo sapiens
ttactcctctatttttaaagtgccaaacaaatccccttcctctttctcaaagcacagtaa

SEQ ID NO: 7327 - DNA, 60 bp, Homo sapiens
gacacccacatcctcctcctggaaggcttcctgctctacagctacaagccccagaagtat

SEQ ID NO: 7328 - DNA, 60 bp, Homo sapiens
tctccatcctgctgtctctgtcctgtcccaagttttcaaataaaactttccaaaaaagtg

SEQ ID NO: 7329 - DNA, 60 bp, Homo sapiens
aggcagagatcatggatatgaaggaggagatgatgaatgatgccattgatgatgccatgg

SEQ ID NO: 7330 - DNA, 60 bp, Homo sapiens
aaagtgtctaaatcacaaatctgagaaatagagattgtctgtagttgattgaaacgaggg

SEQ ID NO: 7331 - DNA, 60 bp, Homo sapiens
aagttaaaatatgcttcactagtcacacattccccataccatttcgtgttattcacattc

SEQ ID NO: 7332 - DNA, 60 bp, Homo sapiens
actagctgccccaggaagttgtgtgattttaaatcacttctgtctttgctggaaagtgta

SEQ ID NO: 7333 - DNA, 60 bp, Homo sapiens
taaaggaaaccatcattagcagttgtcccgttgtccgaatcgcactgtatttccaccctt

SEQ ID NO: 7334 - DNA, 60 bp, Homo sapiens
ctgtgctgatacaagcatgaactttctggaatattctgctagtctgaaattacagcaggt

SEQ ID NO: 7335 - DNA, 60 bp, Homo sapiens
gcacgatctattttcatcatcgatttgaaaatatctgtaactcctatagatcctataggc

SEQ ID NO: 7336 - DNA, 60 bp, Homo sapiens
cttcatttacaagaggaatatatttggcttctctcttaagactctgagattcacaatcag

SEQ ID NO: 7337 - DNA, 60 bp, Homo sapiens
cccattgactacttttcattcttcactgtagttttaaagaagaactgtaaatgacggtgc

SEQ ID NO: 7338 - DNA, 60 bp, Homo sapiens
ggagtccactcatccttgcctcctctccctgggttttgttaataaaattttgaagaaacc

SEQ ID NO: 7339 - DNA, 60 bp, Homo sapiens
tgatctacaatgaagccctcaagggctgaaaataaatagggaagatggagacacctctgg

SEQ ID NO: 7340 - DNA, 60 bp, Homo sapiens
ctgagaactaattgtcacagacattggaatatttgtactgctctcgtgccatttgagagg

SEQ ID NO: 7341 - DNA, 60 bp, Homo sapiens
ggcagttttcccggcgttttaggatctgtacatagagaaatatttaaatttttagaagca

SEQ ID NO: 7342 - DNA, 60 bp, Homo sapiens
tgttgatgagactagactctaatggatatgtttatataattccaaacactcaggtgtgtg

SEQ ID NO: 7343 - DNA, 60 bp, Homo sapiens
cttaggagatgctgtagtagtagagataatcaggttctattttaagcaatcagcagagat

SEQ ID NO: 7344 - DNA, 60 bp, Homo sapiens
tgttgctgggtgattttagtctctacaaacagaaagcgtttcaaagcgtcagctgtggga

SEQ ID NO: 7345 - DNA, 60 bp, Homo sapiens
ttaagagcatgtgtcgggaaattcctcagagtgctcagagtccctgtatttttatacctt

SEQ ID NO: 7346 - DNA, 60 bp, Homo sapiens
agaagggtccagaagattattttacgttgagtccatttttaatgttctgatcacctgaca

SEQ ID NO: 7347 - DNA, 60 bp, Homo sapiens
aagttaaatatacttggaaataagcagttctccgaactgtagtatttccttctcactacc

SEQ ID NO: 7348 - DNA, 60 bp, Homo sapiens
gaagagctttaatatatactctatgtagtttaataagcactgtacgtagaaggccttagg

SEQ ID NO: 7349 - DNA, 60 bp, Homo sapiens
gataccaaaacactgacaaagatttaggcactccaagagagtatgacttcgtgtttaatt

SEQ ID NO: 7350 - DNA, 60 bp, Homo sapiens
ggtcagcgcacgctcatgtcactgagttccagccgcttttagagtaaagtcgtttatcat

SEQ ID NO: 7351 - DNA, 60 bp, Homo sapiens
ggtgggaaagttgcctgtggaagggagccttttgctacaatttgtaacttattttctaaa

SEQ ID NO: 7352 - DNA, 60 bp, Homo sapiens
atttgatagtctttgaatttaatcaagaaactacctggaaccagtgaaaaggaaagctgg

SEQ ID NO: 7353 - DNA, 60 bp, Homo sapiens
tgtccacattgtgatgttcagtatttgagcttatagtgaactgagcaatcataaataagc

SEQ ID NO: 7354 - DNA, 60 bp, Homo sapiens
atggaaacagccaacgctgacatcgtcaccctgctacgactggcaaagatgagggaggct

SEQ ID NO: 7355 - DNA, 60 bp, Homo sapiens
ggccccgggtgtacatatataatgtatattttttcaatgttgtcgtgagtgcagcccatg

SEQ ID NO: 7356 - DNA, 60 bp, Homo sapiens
cccatgataggagagtaaggcttatatattttatagtagggcactaaatacaggaaccat

SEQ ID NO: 7357 - DNA, 60 bp, Homo sapiens
gggggcccaggatgtagatattgtacaaaggtttctaaatcccttcttttctatgcactt

SEQ ID NO: 7358 - DNA, 60 bp, Homo sapiens
gcttgctttggaatgattttaggcattgtacaaccttgaatcacttgagcatgtaataac

SEQ ID NO: 7359 - DNA, 60 bp, Homo sapiens
gctcggtgatgttctacaaactctgttttaaggttgagaaagtttcaagggtgaagatct

SEQ ID NO: 7360 - DNA, 60 bp, Homo sapiens
tcgtcagggaaatatagttgtaatatttttacaggatattcctaggtaaatgaaggagcc

SEQ ID NO: 7361 - DNA, 60 bp, Homo sapiens
cagcacacattttcacgtttccacttaaatcgttttgcacaaagtcttgcttcgctcaga

SEQ ID NO: 7362 - DNA, 60 bp, Homo sapiens
gagaaaaatattacccagtaacattgaatgtagatggctaaacgattcttactcagtgtg

SEQ ID NO: 7363 - DNA, 60 bp, Homo sapiens
gtccctcatcattaactatgatctccctaataacagagaattgtacatacacagaattgg

SEQ ID NO: 7364 - DNA, 60 bp, Homo sapiens
gctggtggagtagcagatgatattaatactaacaaaaaagaaggaatttcagatgttgtg

SEQ ID NO: 7365 - DNA, 60 bp, Homo sapiens
gtgacaacacaccttgggtagttctgcttgtgtttttgcatattgtaaaagcagtgtcac

SEQ ID NO: 7366 - DNA, 60 bp, Homo sapiens
aatgcctgtgaatgacacgtcagtgggaaagagctcaagagatgtctctactcaaactgt

SEQ ID NO: 7367 - DNA, 60 bp, Homo sapiens
ttgaagcgtcgaaaaggtcttgattctgagaatgaatttggttagttgcagaagatacat

SEQ ID NO: 7368 - DNA, 60 bp, Homo sapiens
tgtttgaacaaagatgtcgtgcaaactgtactgtgaacaacagttggtttaaaatatgag

SEQ ID NO: 7369 - DNA, 60 bp, Homo sapiens
actgataactagaacttaggttcacgtttatgtaaagtgtgtaaaacctagtagagcttg

SEQ ID NO: 7370 - DNA, 60 bp, Homo sapiens
cctcgtgtcgtctttatctgcctattactcagcctaaggaaacaagtacactccacacat

SEQ ID NO: 7371 - DNA, 60 bp, Homo sapiens
gagcatccatgcgaagatgtcaattccatagatcaataggtttccagttttcttcgtgat

SEQ ID NO: 7372 - DNA, 60 bp, Homo sapiens
taaagatggctacttaggaccatatggatgttgtactgatgtcatttgaccacgtccatt

SEQ ID NO: 7373 - DNA, 60 bp, Homo sapiens
atgctcctgtccacactactcaccaaatatgagatatccgggaagaatggagggtataga

SEQ ID NO: 7374 - DNA, 60 bp, Homo sapiens
agtagatgggcgactgctttgttcacacacatttgattaaaaataaacaaacagcatctc

SEQ ID NO: 7375 - DNA, 60 bp, Homo sapiens
acctccaggatgtctcccggtttcttctttcaaaatttcctctccatctgctggcacctg

SEQ ID NO: 7376 - DNA, 60 bp, Homo sapiens
gaaactattagaaatgactccctttcaaagtcaatctttggaaaatattgaggaggtcac

SEQ ID NO: 7377 - DNA, 60 bp, Homo sapiens
atgaaacagagaagagttgttgacgtctaactccttccattaaattaataagtactgacc

SEQ ID NO: 7378 - DNA, 60 bp, Homo sapiens
cacattgaaagtgactgcatttagggaggtttaacgagttcttactgatcattccacttg

SEQ ID NO: 7379 - DNA, 60 bp, Homo sapiens
caaggacatcagagtgaagtgtcagttgtcagatgattttaaaagttatgtcttcagaga

SEQ ID NO: 7380 - DNA, 60 bp, Homo sapiens
ggactgtagtgcaattaaacccgcgtctaggtgatgcttttaaagttgtagcttcgtgct

SEQ ID NO: 7381 - DNA, 60 bp, Homo sapiens
tctgtctattatgggaaacatcagacgttctgagtaagatatatctcatggcattagtta

SEQ ID NO: 7382 - DNA, 60 bp, Homo sapiens
tttaactggattggcctcatccgtcttcattttgtcagagctcctcaaactatgtgaaaa

SEQ ID NO: 7383 - DNA, 60 bp, Homo sapiens
atgcactcctatgcatgtgaataacatgtggtgtaattctgcttcttacagaagtattac

SEQ ID NO: 7384 - DNA, 60 bp, Homo sapiens
aaatgcctacacgctctttaaaatgcaaggctttctcttaaattagcctaactgaactgc

SEQ ID NO: 7385 - DNA, 60 bp, Homo sapiens
ttggcacacctttctcaagtcacacaaattattgcagttacatacagaattgctgacagg

SEQ ID NO: 7386 - DNA, 60 bp, Homo sapiens
tagaatcttttctggtgaacagatcataaagttctatcaaggagttctatcaaggcatcc

SEQ ID NO: 7387 - DNA, 60 bp, Homo sapiens
tggtcacacgtggatctggtttatgaatgcatttgggatgattttggtaaccagatcacc

SEQ ID NO: 7388 - DNA, 60 bp, Homo sapiens
cttcacagcatgtcagggaaaatcactgtcacacaattccaatggattttgtgctctttt

SEQ ID NO: 7389 - DNA, 60 bp, Homo sapiens
aaactgagcacataggtggaaagagttaagagcaagatggaatgattttttctgttctct

SEQ ID NO: 7390 - DNA, 60 bp, Homo sapiens
gggaaaggacatttgagggaaacatcaaatttccccataaataaatgaatggagtttgca

SEQ ID NO: 7391 - DNA, 60 bp, Homo sapiens
actgtatacaactttgggtgttattaccaaaggtactgtcattgaagtaaatgtgagcga

SEQ ID NO: 7392 - DNA, 60 bp, Homo sapiens
cctaaaagcagtatctgttatttagctgtaaaccaagttggaagctattcggataatttc

SEQ ID NO: 7393 - DNA, 60 bp, Homo sapiens
tgtactggcaggctcgttttacctgattctagaatatttaagaatctaaaaataaagggc

SEQ ID NO: 7394 - DNA, 60 bp, Homo sapiens
atagccataagaaaatatctgctatacaggaaaaccagtattaagcaaataccaccatcc

SEQ ID NO: 7395 - DNA, 60 bp, Homo sapiens
tatatcagaaactcacaaacctagacatggaaaaacagattactgtctattgtcagcatc

SEQ ID NO: 7396 - DNA, 60 bp, Homo sapiens
gtactatatctaggtgtgtgtacaagtgtgtgtaaaaatatataccttgtgtgtaagcag

SEQ ID NO: 7397 - DNA, 60 bp, Homo sapiens
tcccacccaccctcttcaaatgtttactatatagagtattcaaataaactgctgcttaat

SEQ ID NO: 7398 - DNA, 60 bp, Homo sapiens
cagcagatggtacagtgagtgttcagagacgtgggtacaaaccctgtgatgtatgtataa

SEQ ID NO: 7399 - DNA, 60 bp, Homo sapiens
gggtctactgatgagtcaaatctaaatcaagatctagtttggaaagcatcaagagaatat

SEQ ID NO: 7400 - DNA, 60 bp, Homo sapiens
agtcagttgtcaatggaattgagctatctgctaagacaaaaaatgttacctcagttcact

SEQ ID NO: 7401 - DNA, 60 bp, Homo sapiens
tgcgtttgtgccgagcttctatttcatattgcaaatataaataaaggaaggcagtttacg

SEQ ID NO: 7402 - DNA, 60 bp, Homo sapiens
cctgtaatccccacagtaagaaagttgtatggcatattccaacaagtattggttcgtctg

SEQ ID NO: 7403 - DNA, 60 bp, Homo sapiens
atttcacacctaacacatatgacactttgatggactcttaaacctcctaatcgaacatgg

SEQ ID NO: 7404 - DNA, 60 bp, Homo sapiens
ttcgcagatgtgtatactcatgataggtcagaaagtgtatccgctacaataaagttctgg

SEQ ID NO: 7405 - DNA, 60 bp, Homo sapiens
acggcaaccattatttgtaactgtttagtgctgtaaagaaatattccaagtgtcattagg

SEQ ID NO: 7406 - DNA, 60 bp, Homo sapiens
tgccaaaataactttttgtatcaaatattgatgtgtgaaagtgaaggagctagtctgctg

SEQ ID NO: 7407 - DNA, 60 bp, Homo sapiens
attataattttgatgtgtcacaaaacattactcatttgatttcccccacccccgccaacc

SEQ ID NO: 7408 - DNA, 60 bp, Homo sapiens
agaggttgcaatacttagtatagtaaataaataaacggtcaacattgtgcaaccactacc

SEQ ID NO: 7409 - DNA, 60 bp, Homo sapiens
gccctgcttctgctggggctgtgtacagagtgcaaatgtttatttaaaataaagttctat

SEQ ID NO: 7410 - DNA, 60 bp, Homo sapiens
gcctttacttttaacgctctctgttctgaaaaagaggtgtttggttacgtgtgagccaac

SEQ ID NO: 7411 - DNA, 60 bp, Homo sapiens
agccaagggtctttcacatcacctatccctacatacataccaaatggaaaagtggccatc

SEQ ID NO: 7412 - DNA, 60 bp, Homo sapiens
tgtgcctcattatcttgcagctgtaaacatattggaatgtacatgtcaataaaaccactg

SEQ ID NO: 7413 - DNA, 60 bp, Homo sapiens
tagacatggaattggtttcagtcaaacgacagatccagaatattaaacagacaaacagtg

SEQ ID NO: 7414 - DNA, 60 bp, Homo sapiens
gcttgagagaaatgagtttatacagagctgactcaaaaagacaaaaagtaacttgggcca

SEQ ID NO: 7415 - DNA, 60 bp, Homo sapiens
gtatgtatgtaaatgcatcagtgtgtagattgcatatcagtgtatggtacatgtacatca

SEQ ID NO: 7416 - DNA, 60 bp, Homo sapiens
gaatctctaaactcagaaacaattaccaaaaaatacataactcttccttgtagggccctt

SEQ ID NO: 7417 - DNA, 60 bp, Homo sapiens
ctgactgaaaactgagttaacaagacgaaatctaaaggatattcacagtgacttcaattc

SEQ ID NO: 7418 - DNA, 60 bp, Homo sapiens
gttttatttgattaagcttcaggactgttttgtaaagcgaggtgggaccgatgtggcaca

SEQ ID NO: 7419 - DNA, 60 bp, Homo sapiens
catagtccatatcaccacaaatcacacaacaaaaaggagaagagatattttcggttgaaa

SEQ ID NO: 7420 - DNA, 60 bp, Homo sapiens
cgcaggaacgggtgggtaattctagagacaaaagccaattaaagtccatttcagaaaaaa

SEQ ID NO: 7421 - DNA, 60 bp, Homo sapiens
agcagagcacctgtttaagcattgtacccctattgttaaagatttgtgtcctctcattcc

SEQ ID NO: 7422 - DNA, 60 bp, Homo sapiens
gtgtaaaatggacttctgacagcaagtatattatgtgtggatctgatgaaatgaacattc

SEQ ID NO: 7423 - DNA, 60 bp, Homo sapiens
gtaaaatctcagatatctgtttattctgagctcaacaagattgaagtaagttttcgggag

SEQ ID NO: 7424 - DNA, 60 bp, Homo sapiens
cttttaacgtgagggtctttattggataggactactccctatttcttgcctagagaacac

SEQ ID NO: 7425 - DNA, 60 bp, Homo sapiens
acagtctcaccagacttctcataatgctcttaatatattgcacttttctaatcaaagtgc

SEQ ID NO: 7426 - DNA, 60 bp, Homo sapiens
atgactacaaacactctcctatcaatcacttcaggctacttttatgagttagccagatgc

SEQ ID NO: 7427 - DNA, 60 bp, Homo sapiens
ttccataatgctcctgtacccagtttatttaaggggacatgcactggaataggaaatgtc

SEQ ID NO: 7428 - DNA, 60 bp, Homo sapiens
tctatgcctaatactcacacgcaacatttcttgtactttgtaagtcgtttgcgagaatgc

SEQ ID NO: 7429 - DNA, 60 bp, Homo sapiens
tgctgaagatgcttcgggaagatttgaagaaggaaaaagaagacaaagctcaccttcagg

SEQ ID NO: 7430 - DNA, 60 bp, Homo sapiens
tgtaaaatactgggacttaagtatacaattcagtcactaactgtacagttttatgtgggg

SEQ ID NO: 7431 - DNA, 60 bp, Homo sapiens
acagcgaggttctttctgatactaaaaacctttctttcaggcagcaaatgaacttgaaag

SEQ ID NO: 7432 - DNA, 60 bp, Homo sapiens
ccttgtcttttttaactgagaaaggagattttttgaaaagagtacaattaaaaggacatt

SEQ ID NO: 7433 - DNA, 60 bp, Homo sapiens
taaatattggacatactggttttaatacctgctttgcatattcacacatggtcaactggg

SEQ ID NO: 7434 - DNA, 60 bp, Homo sapiens
tccccactgcccttgtcctggatccaacaccaaataaaaagaaacaagtgaagtaaaaaa

SEQ ID NO: 7435 - DNA, 60 bp, Homo sapiens
tgcatgtgaacaactggagccgaaaacatgcctcagtataaaacaaacattataaaacga

SEQ ID NO: 7436 - DNA, 60 bp, Homo sapiens
tgatcacatgggtaactaccctatcgttttgctaatagaaaatgcagatgatttgcagtg

SEQ ID NO: 7437 - DNA, 60 bp, Homo sapiens
ccgccgcacctacagtgtctcattccccatgtttagcaagattgcagtcaccggtactgg

SEQ ID NO: 7438 - DNA, 60 bp, Homo sapiens
cgaaggtgagccctttctgcacaaaaccagcaattgtaaatactttttaaaaatgtacaa

SEQ ID NO: 7439 - DNA, 60 bp, Homo sapiens
tgagtgagagatttcgaacgcccacccctcgactttgaaatctgagcaaaacaagaaact

SEQ ID NO: 7440 - DNA, 60 bp, Homo sapiens
agccccgcccccgtgggtctctgactctgtcgcttttctctaagtaaagatttcacgtcc

SEQ ID NO: 7441 - DNA, 60 bp, Homo sapiens
gatgaatattgctttgtagctttgaaatacgacagtgttccaaatcccatcaacaaaatg

SEQ ID NO: 7442 - DNA, 60 bp, Homo sapiens; identical to SEQ ID NO: 6578

SEQ ID NO: 7443 - DNA, 60 bp, Homo sapiens
gaacacactctggaattctctattctcctggtcggggacagtcagagatgatgggggaga

SEQ ID NO: 7444 - DNA, 60 bp, Homo sapiens
cccttcatctttgataaagcactgacatctccttcctaataaatagaccctgagttctgt

SEQ ID NO: 7445 - DNA, 60 bp, Homo sapiens
tctggaactaattatatagaggatatgtctcaatttgttctgcattaatgccacagtggg

SEQ ID NO: 7446 - DNA, 60 bp, Homo sapiens
catcgctcttcctcacaccacaaatctgaacgtgcctctctcttgcttacaaatgtctaa

SEQ ID NO: 7447 - DNA, 60 bp, Homo sapiens
cccaaggagtgatacatatattgtgtatatatttacagctgtattgtaaaagtggggtcc

SEQ ID NO: 7448 - DNA, 60 bp, Homo sapiens
cagaagggtaggttagatgctattaagaaggcacttaatagtacatcatgtaagatggca

SEQ ID NO: 7449 - DNA, 60 bp, Homo sapiens
gagttcttacttcgtttcagtcaagacaatgcttagttcagatactcaaaaatgtcttca

SEQ ID NO: 7450 - DNA, 60 bp, Homo sapiens
ccgttcctcagtcctgtatcatccatacttgtactaccttgtcctatgaagctctgagaa

SEQ ID NO: 7451 - DNA, 60 bp, Homo sapiens
gttttgaggggtaatgatgagactattggatttgaggatattcttaatgatccatcacaa

SEQ ID NO: 7452 - DNA, 60 bp, Homo sapiens
taatacaaggctgtttaaggtcaaagaaagacacttgtttcttacctatttaggaagagc

SEQ ID NO: 7453 - DNA, 60 bp, Homo sapiens
ttgctgtatttgaaggtctccatttgtccacatctgagaaaatcttccgtttccaggaca

SEQ ID NO: 7454 - DNA, 60 bp, Homo sapiens
acggagagcccagacggggcttcttgcatccattccctctttttgttttttaaaataaat

SEQ ID NO: 7455 - DNA, 60 bp, Homo sapiens
tagctcagaatctcaaagcatcaatggactttgaacatagatatttaccattgtctgatg

SEQ ID NO: 7456 - DNA, 60 bp, Homo sapiens
ctaaggagaaacctttaaccacaaagtttttatcattgaagacaatattgaacaaccccc

SEQ ID NO: 7457 - DNA, 60 bp, Homo sapiens
gagtgttgtccagatgtttctgtactggcatagaaaaaccaaataaaaggcctttatttt

SEQ ID NO: 7458 - DNA, 60 bp, Homo sapiens
ggagtaagagtttgaaaattttgcgaaacatgaaaaagagtatctgtaattcttgcccac

SEQ ID NO: 7459 - DNA, 60 bp, Homo sapiens
aaacagtgtgagctactgccacgctgaaaactacctgtgggttaaggatgtagttccttt

SEQ ID NO: 7460 - DNA, 60 bp, Homo sapiens
ctggttgtccaactaccatatgaagctagaaaatgcacaaacgatattccttatctgtaa

SEQ ID NO: 7461 - DNA, 60 bp, Homo sapiens
ggaagagtctgagttgtctgtttctagaagaaacctcttagagaattcagtaccaaccaa

SEQ ID NO: 7462 - DNA, 60 bp, Homo sapiens
ctggtgactgatatagttgttcagcaataattcatagtctgtgatgaagagtagtgaata

SEQ ID NO: 7463 - DNA, 60 bp, Homo sapiens
gagatttttgaatagctgagcagttgcctataatctgtgatgacataaaagtatttgacc

SEQ ID NO: 7464 - DNA, 60 bp, Homo sapiens
agggaggaggtatattggaactcttctaacctccttgggctatattttctctcctcgagt

SEQ ID NO: 7465 - DNA, 60 bp, Homo sapiens
gaagggactagttaaggattaactagccctttaaggattaactagttaaggattaatagc

SEQ ID NO: 7466 - DNA, 60 bp, Homo sapiens
aaatcaacgaagccatagtagctgttcaggcaattattgctgatccaaagacagaccaca

SEQ ID NO: 7467 - DNA, 60 bp, Homo sapiens
ttacagtgcttagtgtgataaacttctagtcatgtttcctatccaagagaccagttaata

SEQ ID NO: 7468 - DNA, 60 bp, Homo sapiens
ccagaatctgcaagtgactctgatacataaagcatcataggaaatacaattgcagtcgtt

SEQ ID NO: 7469 - DNA, 60 bp, Homo sapiens
cttaccacttacctatgaggtaatgcttgttatcttccatctaataaaaatctgctgcag

SEQ ID NO: 7470 - DNA, 60 bp, Homo sapiens
ttcctgcacctgttacggtttctggaagcagttaataaaaagtaattaaaagtatctcag

SEQ ID NO: 7471 - DNA, 60 bp, Homo sapiens
cacaagaagaaagtatcgggacattattggatgctatcatttgtagaatgtcaacaaaag

SEQ ID NO: 7472 - DNA, 60 bp, Homo sapiens
tcacgtgcaccctcaatttccacaattcacttgaatgacttgttttatttgcaataaaac

SEQ ID NO: 7473 - DNA, 60 bp, Homo sapiens
tgaaatagcttgtaatgttctttacaggagtttaaaacgtatagcctacaaagtaccagc

SEQ ID NO: 7474 - DNA, 60 bp, Homo sapiens
ccagggcttttagaagcagtcatagacatgtcttcaacataccaaataaaatacctttaa

SEQ ID NO: 7475 - DNA, 60 bp, Homo sapiens
ctgcaaggggcgaagcaactttatgtcagtggaaaacgtgtctctttaaagctgctatgt

SEQ ID NO: 7476 - DNA, 60 bp, Homo sapiens
gaataaatagaacctgttgtgcaaccacggtttaaccggagattttgaggctagggtgtg

SEQ ID NO: 7477 - DNA, 60 bp, Homo sapiens
gacaattctgtgtaaatgtacagttgactctgatttggaaatatgaaaatcagtccatcc

SEQ ID NO: 7478 - DNA, 60 bp, Homo sapiens
aaatggggtttcagatctttgtgacgaaatagaatactgtttcatatttgaatcagaggg

SEQ ID NO: 7479 - DNA, 60 bp, Homo sapiens
caggaatcacttgcttttatgtccactttttgagtggtacttaaatgtaaagtaacaacc

SEQ ID NO: 7480 - DNA, 60 bp, Homo sapiens
aggtacctactacatgctgtattgtatgactgtcaggattttaagattatacaagtgaag

SEQ ID NO: 7481 - DNA, 60 bp, Homo sapiens
cttgtaatccaaagttactttgtacagaccttgaagattgaaaaaacacgtctaaagagc

SEQ ID NO: 7482 - DNA, 60 bp, Homo sapiens
tgtgatgccctaagaagcattaagaatgaaggtgttgtactaatagaaactaagtacaga

SEQ ID NO: 7483 - DNA, 60 bp, Homo sapiens
ccgaaggacgtatgaatggatttattgaccagattgatggaatagttcattttgaaacac

SEQ ID NO: 7484 - DNA, 60 bp, Homo sapiens
cagctcttccatcttaatcaacgaatcagagcctaccacaaacatccaaattcggcttgc

SEQ ID NO: 7485 - DNA, 60 bp, Homo sapiens
gaataaaagctacttggccgtaaggctaaaagaccaagatctgagagattcaaggcaaca

SEQ ID NO: 7486 - DNA, 60 bp, Homo sapiens
ccacacgactatgtgacctctttataactggggaagacttcgatgatgatgtgtgatctg

SEQ ID NO: 7487 - DNA, 60 bp, Homo sapiens
tttttatttgtctgtagacagggaacatgatgggcactgacctcctgtaaagaataaaac

SEQ ID NO: 7488 - DNA, 60 bp, Homo sapiens
aagggaggtccatagaatttaggtggtctgtcaactattctacttatgagagaattggtc

SEQ ID NO: 7489 - DNA, 60 bp, Homo sapiens
tttgacttacgacccattttgcaagacttaaagccgaaagaacacattttcagattgtta

SEQ ID NO: 7490 - DNA, 60 bp, Homo sapiens
agatgtagatgcttattctttgctttagaaaacttctcacttaaaaagatggcatgcacc

SEQ ID NO: 7491 - DNA, 60 bp, Homo sapiens
gaaaaaggagagcatcttggacttgtccaagtacatcgacaagacgatccgggtaaagtt

SEQ ID NO: 7492 - DNA, 60 bp, Homo sapiens
agcatcattccttccttaccccctttctagctgtgtgatgtagaccaaagtcgttgcccc

SEQ ID NO: 7493 - DNA, 60 bp, Homo sapiens
tgcagatacagtaacaactgtgatattggaagttcagtcaaatcccaaaataagaaaagg

SEQ ID NO: 7494 - DNA, 60 bp, Homo sapiens
agatgagctggacgactcacaggtgcgtcagatgctgttcgacctggagtcagcctacaa

SEQ ID NO: 7495 - DNA, 60 bp, Homo sapiens
tgccatcacgcctacatcgtgctatgcattgagaacagcttcatgactgcctccaagtag

SEQ ID NO: 7496 - DNA, 60 bp, Homo sapiens
tgtggtgagtcaaataagaccattttgattgtaaaccataaaatagttcagcaagtagcc

SEQ ID NO: 7497 - DNA, 60 bp, Homo sapiens
ttcatctgtttcagagtaagttcaatttcaccacggtaaactgggatgttttcaaaagtg

SEQ ID NO: 7498 - DNA, 60 bp, Homo sapiens
atgtcagaggcacataagcttttacaaaaattgttggttcattgtcagaaactgaagaac

SEQ ID NO: 7499 - DNA, 60 bp, Homo sapiens
gaccttttgttactcaaagtaaagtactaggagtcctaagaaatgttctgttcttgtaca

SEQ ID NO: 7500 - DNA, 60 bp, Homo sapiens
gtcacagtgctaagttatctagttggctactattacaccttaaaaattgagtttacacac

SEQ ID NO: 7501 - DNA, 60 bp, Homo sapiens
gatccaggacctggtagcaaggaaactggaggagactcaggagcttctggcagaggttca

SEQ ID NO: 7502 - DNA, 60 bp, Homo sapiens
aactcttgacttataaggctagctacttaataatcactcttgttgatatctctgccgaca

SEQ ID NO: 7503 - DNA, 60 bp, Homo sapiens
gaacctcaagaagaggtatccacaagtgaaaatccacaactctgaagagaaactaccaag

SEQ ID NO: 7504 - DNA, 60 bp, Homo sapiens
ggattacgtgatatattagctgttcttactatgaaaagggatggatctttacatgtgaca

SEQ ID NO: 7505 - DNA, 60 bp, Homo sapiens
ctacttgtaactatagaagtgaattgtggacgtaaaatggttgtgctatttggataatgg

SEQ ID NO: 7506 - DNA, 60 bp, Homo sapiens
ctggagatttacggttccgaatcaaagttgtcaagcacccaatatttgaaaggagaggag

SEQ ID NO: 7507 - DNA, 60 bp, Homo sapiens
gatagaatcacttgaattcctggatgaaatggacgtgctggagcagctcaatgcgcatta

SEQ ID NO: 7508 - DNA, 60 bp, Homo sapiens
aatgaaatggatcacaatgtcatttcctaatacaaggcaggatatgtgggaagaatatgt

SEQ ID NO: 7509 - DNA, 60 bp, Homo sapiens
gaagaccttgctcagagaatggataactacaatttcagatccaatggaagaagacattct

SEQ ID NO: 7510 - DNA, 60 bp, Homo sapiens
aaggccacgtgaagatgctgcggctggtgtttgcacttgtgacagcagtatgctgtcttg

SEQ ID NO: 7511 - DNA, 60 bp, Homo sapiens
aggcttaacatgtccaggttctccccaataacattgtccaggttggttttaaaattccca

SEQ ID NO: 7512 - DNA, 60 bp, Homo sapiens
gatgtcaaattgttcattgacagaaaacccactgaagtatttaaagttaggaagatctgg

SEQ ID NO: 7513 - DNA, 60 bp, Homo sapiens
atcaccccccatcttaagtaattactttctggagtaatcaggtggaaatccatagacaaa

SEQ ID NO: 7514 - DNA, 60 bp, Homo sapiens
ttgtataaggtgttcttgaaagggagttggaattagttggtccctactgtcccccatgag

SEQ ID NO: 7515 - DNA, 60 bp, Homo sapiens
gggggaaaaatggaaccagggcctgacattttataaacaaacaaaatgctatggtagcat

SEQ ID NO: 7516 - DNA, 60 bp, Homo sapiens
atttatggacacacagtttgcatcagaacgtgtttatagaatgtgttttatacccgatcg

SEQ ID NO: 7517 - DNA, 60 bp, Homo sapiens
cccatgacctgtaattgtaaagaagcttggacatctgcaaatgatatttaaaccatcttg

SEQ ID NO: 7518 - DNA, 60 bp, Homo sapiens
ccacaagccttactcacctctctctaagtttagaagcgctcatctggcttttcgcttgct

SEQ ID NO: 7519 - DNA, 60 bp, Homo sapiens
cctgacccaattcagagattctttatgcaaaagtgagttcagtccatctctataataaaa

SEQ ID NO: 7520 - DNA, 60 bp, Homo sapiens
ggggcagagaataaaacgttagttaatccctttgtctgtcaatcacagtctcagttctct

SEQ ID NO: 7521 - DNA, 60 bp, Homo sapiens
caaaagaagcgttgtccaggtgtgtctacatctagtgttacttttaatgagaatttgaat

SEQ ID NO: 7522 - DNA, 60 bp, Homo sapiens
ctatccctggccacacctggggagtaggccaagaaggaaaatctgacgaataaagacccc

SEQ ID NO: 7523 - DNA, 60 bp, Homo sapiens
cgacgatccggacattctcagctggaaaaatcaagcagttttgtaaaacctgcaacactc

SEQ ID NO: 7524 - DNA, 60 bp, Homo sapiens
tagaatcgtgaattgacataatcttgggtaatggaacggagatctgcaacatatctttta

SEQ ID NO: 7525 - DNA, 60 bp, Homo sapiens
tatcaagataccccaaaacagattcggagtaagatcaacgtctataaacgcttttaccca

SEQ ID NO: 7526 - DNA, 60 bp, Homo sapiens
agtttatagctcactgcaaatctaacttcatcatggtgaactaatttagagcatcctcca

SEQ ID NO: 7527 - DNA, 60 bp, Homo sapiens
gaaagcattggttaggaccttttttcctctcagggaactaatgctctgaaaagggatctg

SEQ ID NO: 7528 - DNA, 60 bp, Homo sapiens
actgtgcaaaaggtgtagatgaccagaagaaagacaaaagatttgtaaatgacacactgc

SEQ ID NO: 7529 - DNA, 60 bp, Homo sapiens
taactaaaattctaatgatcttgctaccagcaataaatcaagtaggccaagtgaaactgg

SEQ ID NO: 7530 - DNA, 60 bp, Homo sapiens
tatcagggccagatcatagaaggctattttctattctggggaacgattataacttaaatg

SEQ ID NO: 7531 - DNA, 60 bp, Homo sapiens
gacctcagatcagacagaggactactgttcgaagatttttggaagaatactgagaacggc

SEQ ID NO: 7532 - DNA, 60 bp, Homo sapiens
tttcttccagatgaagaacatctccttctgcggctgccatccccgcaacagctgctattt

SEQ ID NO: 7533 - DNA, 60 bp, Homo sapiens
gttgtagtatgcctcaaatataactgactgtatactatagtggtaacttttcaaacagcc

SEQ ID NO: 7534 - DNA, 60 bp, Homo sapiens
cgaaagactggccatcagatttgcaaattcagaaaatgtgaggaactcaaaaagaagcct

SEQ ID NO: 7535 - DNA, 60 bp, Homo sapiens
ataaaaacacctttaaagcatgagccatgtgcttctttgcccttttctgtcctgttccaa

SEQ ID NO: 7536 - DNA, 60 bp, Homo sapiens
ttggtcttcgtgagttttctcaaatccgatatgatgctgtgaagagtaaaatggatcctg

SEQ ID NO: 7537 - DNA, 60 bp, Homo sapiens
caaccacagtccagattttgaccatgacagagattacgaagatgaaccagtaaacgagga

SEQ ID NO: 7538 - DNA, 60 bp, Homo sapiens
ctcttcctcacctgaaattatgcttcctaaaatctcaagccaaactcaaagaatggggtg

SEQ ID NO: 7539 - DNA, 60 bp, Homo sapiens
ctctacctgtcccctccccctttggttgtatgattttcttcttttttaagaacccctgga

SEQ ID NO: 7540 - DNA, 60 bp, Homo sapiens
gacgtccatattgggaaaaagatataataaagatgcttggattagaaaaagcacataccc

SEQ ID NO: 7541 - DNA, 60 bp, Homo sapiens
tccaaataaattactcatccttaaagtttactccactttgacaaaagatacgcccttctc

SEQ ID NO: 7542 - DNA, 60 bp, Homo sapiens
ctggtgcatggactcaaacttgtgaaaaccaagaagacgtccttcttaaggggcacaatt

SEQ ID NO: 7543 - DNA, 60 bp, Homo sapiens
ttttatgttattggtctaagggacttccatcttggtctgaagtcctgagctcagacgcag

SEQ ID NO: 7544 - DNA, 60 bp, Homo sapiens
cctcaccgtatttctactactacttaatgaaaaagtgtgaactttatagaatcctctctg

SEQ ID NO: 7545 - DNA, 60 bp, Homo sapiens
gctgtcttgttccaccagtatttaccaggaaaacaaagaatgtgttaagggatgctcccc

SEQ ID NO: 7546 - DNA, 60 bp, Homo sapiens
gggaaccttcatgactgttggaattgctctgtcataataagtcagggatatttagggggc

SEQ ID NO: 7547 - DNA, 60 bp, Homo sapiens
ttttttattaaaaaatacccttccacctggaggctcccttgtctcccagccccatgtaca

SEQ ID NO: 7548 - DNA, 60 bp, Homo sapiens
actatttaatacatgacctaggggaggcctaaaacccttttggggataatgtcccagagt

SEQ ID NO: 7549 - DNA, 60 bp, Homo sapiens
actcctgacagccccgccaaaccagagaagaatgggcatgccaaagaccaccccaagatt

SEQ ID NO: 7550 - DNA, 60 bp, Homo sapiens
ggtttccttctcggtttattctgttagaatgaaatggttcccataaataaggggcatgag

SEQ ID NO: 7551 - DNA, 60 bp, Homo sapiens
gagacacgcttcacatacactacacgggaagcttggtagatggacgtattattgacacct

SEQ ID NO: 7552 - DNA, 60 bp, Homo sapiens
ttataaacctcaaagtggattcactttctgatagttaacccccataaatgtgcacgtacc

SEQ ID NO: 7553 - DNA, 60 bp, Homo sapiens
agcagtagctggtagaattaggcagttggtgatagttttactttggtacaaataaaaact

SEQ ID NO: 7554 - DNA, 60 bp, Homo sapiens
tgactgatgttggttgtaatggttgggtttaggatgaaccattttaaggatgccaaatga

SEQ ID NO: 7555 - DNA, 60 bp, Homo sapiens
gtcgattccattaagcaatactaactgacgttaagtcatgatttcgcgccataataaaga

SEQ ID NO: 7556 - DNA, 60 bp, Homo sapiens
ggaaaatcgagctccatactaaaggaagggatcatagaatcttttcttaaagtcattctc

SEQ ID NO: 7557 - DNA, 60 bp, Homo sapiens
ggagcatctaacgcctatgaagcaaaagaggttgttaatagactctttgaggatcctgag

SEQ ID NO: 7558 - DNA, 60 bp, Homo sapiens
tcttcaccatcttttgcaactgaaatatgatggatatgcttaagtacaactgatggcatg

SEQ ID NO: 7559 - DNA, 60 bp, Homo sapiens
cttttctgtgccaaaatcagtaaagttacactctgaagggatatcatcctttcaaacggg

SEQ ID NO: 7560 - DNA, 60 bp, Homo sapiens
gatgtaatgctaattgcttgtaggatagtaaatggtcagtattgaaacctaatctctagc

SEQ ID NO: 7561 - DNA, 60 bp, Homo sapiens
gctaccaaaagtcttcaccactgtgttcttaagtgaatgttaatttctgaggtttgggac

SEQ ID NO: 7562 - DNA, 60 bp, Homo sapiens
cgctggctcacacaaaacagctgacactgactaaggaactgcagcatttgcacaggggag

SEQ ID NO: 7563 - DNA, 60 bp, Homo sapiens
gttctacttcagatagttcactttctactgaatagaccaaaagaagaaaaatcacagctg

SEQ ID NO: 7564 - DNA, 60 bp, Homo sapiens
cacaactagatttgcctcttctaagtgtctatgagcttgcaccatatttaataaattggg

SEQ ID NO: 7565 - DNA, 60 bp, Homo sapiens
ttggcaatgcatttgatggccaccagcttctgcgtcctcttatcttctgccaggatcacc

SEQ ID NO: 7566 - DNA, 60 bp, Homo sapiens
ctccttggcaatgcatttgatggccaccagcttctgcgtcctcttatcttctgccaggat

SEQ ID NO: 7567 - DNA, 60 bp, Homo sapiens
aaacttctattacaccctatattgcatctcctgtatctgcctaccaggtgcaaagtcctt

SEQ ID NO: 7568 - DNA, 60 bp, Homo sapiens
agacgtctaatgaccattctccatatacctttcaacctaataagtaactgtgagatgtac

SEQ ID NO: 7569 - DNA, 60 bp, Homo sapiens
gtttgtttacagagtagtcttaggtagtagcaaaagagccaaagaagagatttgtattgc

SEQ ID NO: 7570 - DNA, 60 bp, Homo sapiens
attcatgctcatcgtatctgtgttggcactgataccagaaaccacaacattgacagttgg

SEQ ID NO: 7571 - DNA, 60 bp, Homo sapiens
aaaccctctccatgtctttacctcccagtcgctctaagatctgcttgaagtctcgtattt

SEQ ID NO: 7572 - DNA, 60 bp, Homo sapiens
tgagcatctcttctccataagatagtgtgataaacacggtcatgaataaagttattttcc

SEQ ID NO: 7573 - DNA, 60 bp, Homo sapiens
gactgtatatcttgtaaaagaacacttgtcacatgcttgatcagttacagcaatagctga

SEQ ID NO: 7574 - DNA, 60 bp, Homo sapiens
cattctggaatcaaatggtctgtcagttcaaacagtggtaggaatgctctataacccctt

SEQ ID NO: 7575 - DNA, 60 bp, Homo sapiens
aatgacttttaaaagatcaaattaaatcaggtcactcctttgcttacaacgcagtgcgtt

SEQ ID NO: 7576 - DNA, 60 bp, Homo sapiens
tactgttcatcaaatctgaaatagtcacctcacagctcttcaaagaaaacctttgaaaga

SEQ ID NO: 7577 - DNA, 60 bp, Homo sapiens
tcaaacaaaacacaaaacaaatccccctgcgaagcaacaataaactttacatctctttgg

SEQ ID NO: 7578 - DNA, 60 bp, Homo sapiens
ctgtgactttaataagctggaacagtccactgaatgggtataatgaattgcagtatatac

SEQ ID NO: 7579 - DNA, 60 bp, Homo sapiens
cagagaggcacctgggtcagtattagtctatttatcagaggtgtaaataatctatgtata

SEQ ID NO: 7580 - DNA, 60 bp, Homo sapiens
ttaatgtatcttaactgttgcctgtcagtgtttacaaactagtgcgttgacggcaccgtg

SEQ ID NO: 7581 - DNA, 60 bp, Homo sapiens
gaaggtatttaaaactgatgttagtaaaattgtgatggaactagacacgttggaagtagc

SEQ ID NO: 7582 - DNA, 60 bp, Homo sapiens
atgggctcaagtctgaagtcaccttaaagagaaatctctacctttctgttctccttcatt

SEQ ID NO: 7583 - DNA, 60 bp, Homo sapiens
gaaagtttcaaaaactttggttcaatctgaagaaaggaagcttgaactgtttgttcttgg

SEQ ID NO: 7584 - DNA, 60 bp, Homo sapiens
ggtcaatatggacatgtctttacattcaatggaagttgtaaatcgactaactacagctgt

SEQ ID NO: 7585 - DNA, 60 bp, Homo sapiens
aggagcatgggtgtggaagtcctgtcagccaagaaataaaagtttacctcagagctgcaa

SEQ ID NO: 7586 - DNA, 60 bp, Homo sapiens
ggacactgggtctgaaaggaaggagtcttttgcttcctttctcctttttacaaaaacaaa

SEQ ID NO: 7587 - DNA, 60 bp, Homo sapiens
gacctttcagttagaatccctagaaaaagagaattcccaacttgatgaggaaaacttaga

SEQ ID NO: 7588 - DNA, 60 bp, Homo sapiens
ttttttaaagtgggggaaaaacatccaagcactttaattccaatgtaccaggtgaactga

SEQ ID NO: 7589 - DNA, 60 bp, Homo sapiens
tctgttcctagattggatgtgtgtgttctaagaagttgtcataaataaaacctgaatgac

SEQ ID NO: 7590 - DNA, 60 bp, Homo sapiens
acggggctttaggtctgcttgaaaggtgaggacgtgactcccacatgtaatcaggagaaa

SEQ ID NO: 7591 - DNA, 60 bp, Homo sapiens
tcaaacctgccatgttctgtcatgaatactcacaaattatttagtatacctgaatcttgg

SEQ ID NO: 7592 - DNA, 60 bp, Homo sapiens
ggtgttagctgaccaaaatgtcattcctaatgtggctaatgtcacttgctattaccagcc

SEQ ID NO: 7593 - DNA, 60 bp, Homo sapiens
ggctaaaattatctaatttccagatgcttttgtagatgactgaagtatttgtgagccaca

SEQ ID NO: 7594 - DNA, 60 bp, Homo sapiens
acttggtctctggaggttttaccacatgtaacagattcctttatatgtagtgaaaatcac

SEQ ID NO: 7595 - DNA, 60 bp, Homo sapiens
tagtgctagatactgtaaagtctcttcttctcaaaggaacctactgtctagtttgagata

SEQ ID NO: 7596 - DNA, 60 bp, Homo sapiens
ggagctacagtacatattggcagaaaaaggtaaactttcgtaatctcattggaattacaa

SEQ ID NO: 7597 - DNA, 60 bp, Homo sapiens
taaagttagtttcagaacaattactcatgccttcctttctcatccctaaaacattggtgg

SEQ ID NO: 7598 - DNA, 60 bp, Homo sapiens
gcagactcgcgattcaatgatcgatatgctcataaaagtgctcaattatattttctgtat

SEQ ID NO: 7599 - DNA, 60 bp, Homo sapiens
aagataaaggcacaaaaataaaagaagcgtattactgggtatagtatgtgactcctcttc

SEQ ID NO: 7600 - DNA, 60 bp, Homo sapiens
ctttcttcatgatcagacataaacttagcatcttaatggaagaaaaatgaggggaacttc

SEQ ID NO: 7601 - DNA, 60 bp, Homo sapiens
gtacaaatgctttcttctgttcgactcaatttacggggcttgttatctaaagcaaagcaa

SEQ ID NO: 7602 - DNA, 60 bp, Homo sapiens
ccttgatgtggaatagtgcaacctgtatatgggttattataataggaaagacatttgtac

SEQ ID NO: 7603 - DNA, 60 bp, Homo sapiens
atgtatatcctgttatcaataaaacaattatccaagtggttgaatcctgtgagacttggc

SEQ ID NO: 7604 - DNA, 60 bp, Homo sapiens
taattgttaagctgcagttgagttgttcaagtgagagttttgataagccacttatgggcc

SEQ ID NO: 7605 - DNA, 60 bp, Homo sapiens
ggctacagtgtattgaagaggccatagtacctcctgtttgaagttgtttattcacatcta

SEQ ID NO: 7606 - DNA, 60 bp, Homo sapiens
tccctggggatcttttctttcctcccacatatcaaaagagctctacaggcctattgtatg

SEQ ID NO: 7607 - DNA, 60 bp, Homo sapiens
ttacctaaggaaaaagacagtttttctaggtaccatgaaggaagattgaccctgttggta

SEQ ID NO: 7608 - DNA, 60 bp, Homo sapiens
gcctcaaaagttactatggtgcttaagattgtcttgatctgacatatatcaccttctggg

SEQ ID NO: 7609 - DNA, 60 bp, Homo sapiens
ttaaactgaccacttggaagaaacaccttggtatctgtggttttcttgccttgtccctgc

SEQ ID NO: 7610 - DNA, 60 bp, Homo sapiens
accacttaccaagtatctgaagagatgagttcatactatgatttagaaagtggttcgatt

SEQ ID NO: 7611 - DNA, 60 bp, Homo sapiens
gaaaacaggagcttttcaggtggtaactccccaacctgacattggtactgtgcaataaag

SEQ ID NO: 7612 - DNA, 60 bp, Homo sapiens
gtcattaaaggacactcttgagtattagtaaaccctcttatgatgattaaaagagaaggg

SEQ ID NO: 7613 - DNA, 60 bp, Homo sapiens
gtggcgagggtgatgctggctgctcttctgaacaaataaaggagcatgccgatttttaaa

SEQ ID NO: 7614 - DNA, 60 bp, Homo sapiens
ccagacaatgaaataaccatcaaaaagctaaggaaaaaggttttagctcagtactacaca

SEQ ID NO: 7615 - DNA, 60 bp, Homo sapiens
aattattttccagaatgacacccgcagcagaatgttggagtggaaatgatggctggctat

SEQ ID NO: 7616 - DNA, 60 bp, Homo sapiens
cccaactgactgtagggttgtgtcttttcccaattaagtatctgcagaactttgggatta

SEQ ID NO: 7617 - DNA, 60 bp, Homo sapiens
cattcccatccgaatgtccactgcgctcacagattcctttcctcctaaaacttcagcctt

SEQ ID NO: 7618 - DNA, 60 bp, Homo sapiens
ggattgttgacttgtagttcagaggcgtacaactagttggcgattagacttgttatgtga

SEQ ID NO: 7619 - DNA, 60 bp, Homo sapiens
atgaaccattatcttagcatggtaaacctgggttttgttcatattttctccagacagaaa

SEQ ID NO: 7620 - DNA, 60 bp, Homo sapiens
atggggcctcatacaacccttcatctgcactcaacatttaatcgtgtccttgctgtcttt

SEQ ID NO: 7621 - DNA, 60 bp, Homo sapiens
atttgtcaacaaaggagaaaaagggatcatggttttggcaggagacacactgcccattga

SEQ ID NO: 7622 - DNA, 60 bp, Homo sapiens
tgagtgtaggagataactgtatataggctactgaaagaaggattctgcatttctattccc

SEQ ID NO: 7623 - DNA, 60 bp, Homo sapiens
tgcaggcatttctgcacctttgggtcatgctttgtagcagtgtctcccttgcgacctcgc

SEQ ID NO: 7624 - DNA, 60 bp, Homo sapiens
tagtcaagcttcattggacaacacagatgatgaacaaccaaaacaaccaattaaaactac

SEQ ID NO: 7625 - DNA, 60 bp, Homo sapiens
cactccctagaaactgcactttctttgaaaccataggtaatgaatcttactaggagaggc

SEQ ID NO: 7626 - DNA, 60 bp, Homo sapiens
ctgttaccatctcagaggaagtaactgggcatggtgagactcctaaaatgacaggagttt

SEQ ID NO: 7627 - DNA, 60 bp, Homo sapiens
ctgcctcctgacccaggactgttgaatacaaagatgttaatttttaaaatgttactagta

SEQ ID NO: 7628 - DNA, 60 bp, Homo sapiens
agaaacggcataaagatgagaaatgagcctatttgttagtgttcgtgcttaaatgtgatt

SEQ ID NO: 7629 - DNA, 60 bp, Homo sapiens
tacttggtttttaagcgactggttgggatagaaccctaaagaaataaacttccagtggat

SEQ ID NO: 7630 - DNA, 60 bp, Homo sapiens
aggagaacatggccacccacttctctcaactcagcctgcacaatgaccacccctactgca

SEQ ID NO: 7631 - DNA, 60 bp, Homo sapiens
aaacaacactttggtgtggtggtatggtacgtagctattttcctaagcatgtctgtcaat

SEQ ID NO: 7632 - DNA, 60 bp, Homo sapiens
gcaccttgtgtcttgtagggtatggtatgtgggacttcgctgtttttatctccaataaaa

SEQ ID NO: 7633 - DNA, 60 bp, Homo sapiens
agcagggggatgaaggcgtcgcggatgcgcctcaaattcagtgcaaaaacgtgctgaaga

SEQ ID NO: 7634 - DNA, 60 bp, Homo sapiens
gaatcacagatgtctcctgaaagaactcttttagatgaaatcattctactcaaatgtacc

SEQ ID NO: 7635 - DNA, 60 bp, Homo sapiens
tcactgcggcttatacagtaccctaacctgctactaatcacagagaaaaatgtgaagaag

SEQ ID NO: 7636 - DNA, 60 bp, Homo sapiens
accacaacttaactgagtactccagatgacagtaactgacttgaagatggaaaaatatca

SEQ ID NO: 7637 - DNA, 60 bp, Homo sapiens
caaataggcttaactattttgaaggttggatgaaaagagatgggtcagtattcctacaga

SEQ ID NO: 7638 - DNA, 60 bp, Homo sapiens
ttcaggatatttcgatgtcagaaataacgcatcttaggaatgactaaacaagataatggc

SEQ ID NO: 7639 - DNA, 60 bp, Homo sapiens
cccttgtgagacaagttttctacttgagaaactcctagtacaatgtcttatactagaagc

SEQ ID NO: 7640 - DNA, 60 bp, Homo sapiens
cgttatttgcaaaatgagagtttctttgaactgtctcacgtgactattaagcaactatac

SEQ ID NO: 7641 - DNA, 60 bp, Homo sapiens
gcgcgggagacattgtatacacatcatgctatttaaaatacgttcaaactatagtgtaaa

SEQ ID NO: 7642 - DNA, 60 bp, Homo sapiens
ccaaatatctctgaggaaaaattaaaggaactggtgattttgctggaaaaatagcaagac

SEQ ID NO: 7643 - DNA, 60 bp, Homo sapiens
gctgaatcagcaataagtattagtctttttggactatggtattgttaaaaagactgcagc

SEQ ID NO: 7644 - DNA, 60 bp, Homo sapiens
gctgtgttcttgctggtgagcaaagtgttgcctgcaaaaataaaatgcagaacgtactct

SEQ ID NO: 7645 - DNA, 60 bp, Homo sapiens
ttcacgatgctgctctggtgattcttgtacctaatctggtgtgctcaccaatgagtgaaa

SEQ ID NO: 7646 - DNA, 60 bp, Homo sapiens
ggacacctaggttccaattcattcacattcttggttccagataaaatcaactgtttatat

SEQ ID NO: 7647 - DNA, 60 bp, Homo sapiens
gaggaccgcgtttctgtaatgacccagatttaaaagacataaggtggataattctacatt

SEQ ID NO: 7648 - DNA, 60 bp, Homo sapiens
gggtctctacaagtgacagatgtgttgttttcaacagtattattaggttatgaataaagc

SEQ ID NO: 7649 - DNA, 60 bp, Homo sapiens
gagctttgtatttttgttacgtactgtttctttgataattgatgtgataaggaaaaaagt

SEQ ID NO: 7650 - DNA, 60 bp, Homo sapiens
ggacatgcctgttgataacatgcatctcagtgtaggttctatttatatggcagatgacgt

SEQ ID NO: 7651 - DNA, 60 bp, Homo sapiens
cctggaatcagtgttactgcatctgattaaatgtctccagaaataaagaataattctgcc

SEQ ID NO: 7652 - DNA, 60 bp, Homo sapiens
cattaacagaccctttatcaacataaacaatagtaactgagctattaaaggcaacctctc

SEQ ID NO: 7653 - DNA, 60 bp, Homo sapiens
agatgggacagtaaatgttcagcattcttggatcagaagaaaacggactaattagatgct

SEQ ID NO: 7654 - DNA, 60 bp, Homo sapiens
tagaggtatgtggagctggtactgtctctggaattttaatcacaataaagtttggcaagg

SEQ ID NO: 7655 - DNA, 60 bp, Homo sapiens
tggagcataaggtttatctcaagtctcaattgaactgcctcctcttgtcaggcagggaca

SEQ ID NO: 7656 - DNA, 60 bp, Homo sapiens
cagatacctctaaaacagcaaactgtgattctcaagattagaaagtaacaaggaatatgc

SEQ ID NO: 7657 - DNA, 60 bp, Homo sapiens
gcaagacaatttttgatactggaactatgctttgaaatacaccttacactcttcatagtg

SEQ ID NO: 7658 - DNA, 60 bp, Homo sapiens
ctagcccctgatcccaaatctgtttacacatcaatctgcctcactgctgttctgggccat

SEQ ID NO: 7659 - DNA, 60 bp, Homo sapiens
ggttttgcttgaaattttttccaaaaattaccgggtacgccgaaacatgatccagtctcg

SEQ ID NO: 7660 - DNA, 60 bp, Homo sapiens
aagtctgtacatattggagctctgggagatgctggaataaaagacaagagttacatctgg

SEQ ID NO: 7661 - DNA, 60 bp, Homo sapiens
gggtctaagtgtccgagacttaacgaaaatagtatttcagctgcaataaagattgagttt

SEQ ID NO: 7662 - DNA, 60 bp, Homo sapiens
ggtcatcctttcaaaatttttactaagatggcagtagtacgttacatgttcttcaacaga

SEQ ID NO: 7663 - DNA, 60 bp, Homo sapiens
gccccttcagaatataacttcaggacaattcaaactatgcttaatgtatgattttcgagc

SEQ ID NO: 7664 - DNA, 60 bp, Homo sapiens
tttgagacaaactgactattaatcttgtatccagtatcctgagatgaagtaaatgcagtg

SEQ ID NO: 7665 - DNA, 60 bp, Homo sapiens
aaaccatctgagttctaactccttggttgcttaaaagtagttcccaagagtctgagaagc

SEQ ID NO: 7666 - DNA, 60 bp, Homo sapiens
aattaatgggaaaagtctcaagaagtatatggaggacagatcaaaaaccaccaatacttg

SEQ ID NO: 7667 - DNA, 60 bp, Homo sapiens
catgtctcaacttagcgaggaagaacagaataaagattatcaagactgtagcaaaaccac

SEQ ID NO: 7668 - DNA, 60 bp, Homo sapiens
tcgctgacaaagtgaagcggtttttctccaagtactccatgaacagacacaagatgacca

SEQ ID NO: 7669 - DNA, 60 bp, Homo sapiens
aattaaaatggcttgagaactttgggtagccatgtgtaagaaatggatggtattcaccgg

SEQ ID NO: 7670 - DNA, 60 bp, Homo sapiens
acaaaaagccgtctatgggattaaaagacacgtgaaatgatacttttattattcccttgc

SEQ ID NO: 7671 - DNA, 60 bp, Homo sapiens
cagcccagcccgcctgtccctagattcagccacatcagaaataaactgtgactacacttg

SEQ ID NO: 7672 - DNA, 60 bp, Homo sapiens
gcattttgttcactatccactactgttcgttagccagaaattctctagtgatctgaagca

SEQ ID NO: 7673 - DNA, 60 bp, Homo sapiens
cttaagatagccctaaatgtactcttgaacttcttactggaacaatgtttgatactctag

SEQ ID NO: 7674 - DNA, 60 bp, Homo sapiens
gatagggaagtgtctaatgtatgtgcacatataagtaatacaaaagttttgagctcttcc

SEQ ID NO: 7675 - DNA, 60 bp, Homo sapiens
ggagaattcacacttattgagtaactgatgtcatacaacctggaatttctgaattccaaa

SEQ ID NO: 7676 - DNA, 60 bp, Homo sapiens
gaatcgtcgcattataactgttgtagaatcttaaatgttaccaagatgattccaatgagg

SEQ ID NO: 7677 - DNA, 60 bp, Homo sapiens
ccagctctgaactagttttaaggtagcttaggatgaaaaatggagaatgattgggggttc

SEQ ID NO: 7678 - DNA, 60 bp, Homo sapiens
gcccagaaagtgattcatttgtaaattatcatggttttctttctgcattaaaatgctcat

SEQ ID NO: 7679 - DNA, 60 bp, Homo sapiens
agtgggatgtggtgttccacatgtgcctgtttccacgccagcaccttgacttggcagcat

SEQ ID NO: 7680 - DNA, 60 bp, Homo sapiens
attctactctctcaaacggtgcaggtcgaaatttcagaaaaacactgttagttcggggcc

SEQ ID NO: 7681 - DNA, 60 bp, Homo sapiens
tgggactgctgtgatggggtatcacggtgatggtcccattaaacttccactctgcaaacc

SEQ ID NO: 7682 - DNA, 60 bp, Homo sapiens
actggaaggatgattttgtctcagtttgtactcctaaataaaaagtaaacatgacacctc

SEQ ID NO: 7683 - DNA, 60 bp, Homo sapiens
cttgcttagtctcctttcagtatttggcaataaaagaaagaagaaatagaacagctgaag

SEQ ID NO: 7684 - DNA, 60 bp, Homo sapiens
aatgatcatattagagtgactgagtgaccttttgattttgaagcagactaaaatctgacc

SEQ ID NO: 7685 - DNA, 60 bp, Homo sapiens
tagaaacaagtcaaagccaaagtcatacactggctatcagaaaattatgctggaagaatt

SEQ ID NO: 7686 - DNA, 60 bp, Homo sapiens
tagataacattgttaagctgtgggatacaagaagttgtaaggctcctctctatgatctgg

SEQ ID NO: 7687 - DNA, 60 bp, Homo sapiens
gagctggtaaacacaaatcatgtcaataaaggtagtcaggatattttatccttagcattg

SEQ ID NO: 7688 - DNA, 60 bp, Homo sapiens
attgcctacaggataaaattcaaacttcctagtgtggtgtacaagaccctttacagcccg

SEQ ID NO: 7689 - DNA, 60 bp, Homo sapiens
gctttacacaatctgttctataaggttcaggtgttttcaagttggaacgatcataaatac

SEQ ID NO: 7690 - DNA, 60 bp, Homo sapiens
catgttacctggactggaacagactgtgaatatagcagaaggttccaagaactctggtgt

SEQ ID NO: 7691 - DNA, 60 bp, Homo sapiens
acagcattctagcaatccttcgacttttgtgatagcaaaccataaaaacaattttagtgg

SEQ ID NO: 7692 - DNA, 60 bp, Homo sapiens
cctttaccctggttctgagtttacaaagtctcttcctcattcccgttgagttctttccca

SEQ ID NO: 7693 - DNA, 60 bp, Homo sapiens
accaagccagaccaataaacagaacacttttccttccatgtggtctgaatgttggcacca

SEQ ID NO: 7694 - DNA, 60 bp, Homo sapiens
gttccctcttcagttaaacctaagtagtttctcactttttgaaacaataactctgcacca

SEQ ID NO: 7695 - DNA, 60 bp, Homo sapiens
ccttctccagacttcagtaaaattgcttggttccttgtcacaagcgcaaatctgtccaag

SEQ ID NO: 7696 - DNA, 60 bp, Homo sapiens
aagtgaaagatgtgcaaaaactgagaaagaaagagccgaagactcttcttccacatgatc

SEQ ID NO: 7697 - DNA, 60 bp, Homo sapiens
cttttcttccatgagttctgtctgaactgaacatgtaaaaagtatgggaaacagatgaat

SEQ ID NO: 7698 - DNA, 60 bp, Homo sapiens
gtttaatggtgaagatgattaacaggggaaatgcttgaagtaaatgattgtttcaatggc

SEQ ID NO: 7699 - DNA, 60 bp, Homo sapiens
ttcagctgtatctgtagaaactctttgacgaacctcaatttaaccaatttgatgaatacc

SEQ ID NO: 7700 - DNA, 60 bp, Homo sapiens
gagagaaactacctacctcacttcaaattatgtttggacttgacaaaaataggtgcaaat

SEQ ID NO: 7701 - DNA, 60 bp, Homo sapiens
gctgacaaggttttgtctgtttcagttatacttgtgaattgagatctaactgcagaaagg

SEQ ID NO: 7702 - DNA, 60 bp, Homo sapiens
gccgtgccctcaacaatttcaggggtggtgtgattctggtgtcccacgatgagcgcttta

SEQ ID NO: 7703 - DNA, 60 bp, Homo sapiens
ttgcatggaatgagattacagggcagataaagtttctgattctagatccacattataccg

SEQ ID NO: 7704 - DNA, 60 bp, Homo sapiens
cctgacctgcataagatcacttgaatgttaggtttcatagaactatactaatcttctcac

SEQ ID NO: 7705 - DNA, 60 bp, Homo sapiens
cagaagtagggaccgctttcttacctgtttaaataaaccaaagtataccgtgtgaaccaa

SEQ ID NO: 7706 - DNA, 60 bp, Homo sapiens
gaaagctactttgtggtgtctaggtttctgataaaagggatgatcttaactgaagaattt

SEQ ID NO: 7707 - DNA, 60 bp, Homo sapiens
cttatttatggactgttggggatgagagcaggcaacaaatgccaaggtcagacttggtaa

SEQ ID NO: 7708 - DNA, 60 bp, Homo sapiens
gtattctggctaacttgatatacatgggacacgtcaaaggctacatatcgcatcagcatc

SEQ ID NO: 7709 - DNA, 60 bp, Homo sapiens
cctattgaacaacaatacagtacaacacagaatgttagagaaaaagcctttttatcctgc

SEQ ID NO: 7710 - DNA, 60 bp, Homo sapiens
agtttagtagcagtaatagtaaatcatgtttacatatgagatttatagtcgtgggagggg

SEQ ID NO: 7711 - DNA, 60 bp, Homo sapiens
tgccacctaaatcagaagacgttctaaagtcagtaagaaagtgtgaaatgctagtataaa

SEQ ID NO: 7712 - DNA, 60 bp, Homo sapiens
acagtagaaggccaatattacttacagatatgtgcattactgaagtgtcaaaccactgac

SEQ ID NO: 7713 - DNA, 60 bp, Homo sapiens
aattgagcctatgagaaagagactcatttcttaagaatgttttccaagtgacattctcag

SEQ ID NO: 7714 - DNA, 60 bp, Homo sapiens
agcaccttgaaaatgtgcattttcaaggacacttgctgggttgtgcattaagggccagtt

SEQ ID NO: 7715 - DNA, 60 bp, Homo sapiens
gactacctgaattgcaagggatttttatatattcatatgttacaaagtcagcaactctcc

SEQ ID NO: 7716 - DNA, 60 bp, Homo sapiens
aagagcactgcctctatagggtaacctggaacattctctaggttatatcaatataaaaca

SEQ ID NO: 7717 - DNA, 60 bp, Homo sapiens
ctaaaccttgtagacaagtgagtcatctgatatgtatagaagctgtgatatatagagtac

SEQ ID NO: 7718 - DNA, 60 bp, Homo sapiens
acaagggctagaaaagaatgtaatctgatatggaaggatagcagcttctaattttcaatc

SEQ ID NO: 7719 - DNA, 60 bp, Homo sapiens
gggacctttctgttgtcaaaaagatgaaggagacctttaaggagaaagctaagctctgag

SEQ ID NO: 7720 - DNA, 60 bp, Homo sapiens
taagtatactcacactaggaaaaatctgtgtacatgtagcaaatgtgggaaagactatag

SEQ ID NO: 7721 - DNA, 60 bp, Homo sapiens
aagcaacacatctccattctagttgtcttgaaccacgtgggcaactgtttcaggggtttt

SEQ ID NO: 7722 - DNA, 60 bp, Homo sapiens
cttcctacttgcctaggctctaattagtcagcaatcaggtttaataaaggacatttgaaa

SEQ ID NO: 7723 - DNA, 60 bp, Homo sapiens
atcttttttgtaatgttggcatacttggggaatttagtggcaaatacattccccagcagg

SEQ ID NO: 7724 - DNA, 60 bp, Homo sapiens
ggaacagagtagattcttcatagacaaatgaaatcatgcttaccaatcaaatctcaaagc

SEQ ID NO: 7725 - DNA, 60 bp, Homo sapiens
ctttactctgattacccactcactacatgaagtcctgaaaataacagagaaactgttata

SEQ ID NO: 7726 - DNA, 60 bp, Homo sapiens
caataaatataagtttcatcttacacgtaagatacaggtcttatctcctgatggtgtgtc

SEQ ID NO: 7727 - DNA, 60 bp, Homo sapiens
agatggaggtgtaggctggagagacattgtgggtgtgtatcttcttatctcatttcacaa

SEQ ID NO: 7728 - DNA, 60 bp, Homo sapiens
aaagggaatctgaagcatgtggtctagttgacagaaagagatcaggtttccagagctgag

SEQ ID NO: 7729 - DNA, 60 bp, Homo sapiens
gcagaaatttagataaggatatccttaaacagctgtttatagctactgtgacagaaacag

SEQ ID NO: 7730 - DNA, 60 bp, Homo sapiens
ttgcgctaggttctaacatcgttggccatagattaccacaaaacataatttcttaaattc

SEQ ID NO: 7731 - DNA, 60 bp, Homo sapiens
tgatcctcagtggtaagtagcagaaatcaactgtatttgtttgctaaggctgtgctaata

SEQ ID NO: 7732 - DNA, 60 bp, Homo sapiens
agttaaaagtaacaagcattaacagatagatacatacaaaactcagcctgatcagactgg

SEQ ID NO: 7733 - DNA, 60 bp, Homo sapiens
gaggttctctattgcctcttgaatacaaatgcactcccaaagtggttttaagaaaataaa

SEQ ID NO: 7734 - DNA, 60 bp, Homo sapiens
ttattaagccttcctttaccttgtagtacaaggtgctttaatgggatagaactaagcata

SEQ ID NO: 7735 - DNA, 60 bp, Homo sapiens
aaatatgccccttccttgcacagaggccatgctaatttgtgaagcattccatttaaaaaa

SEQ ID NO: 7736 - DNA, 60 bp, Homo sapiens
gaggggaagatagtctgaatggaaatctgaaatacggaatgttttagagaaatatgtcac

SEQ ID NO: 7737 - DNA, 60 bp, Homo sapiens
gaaggaggattatttactggtggtctaaaagaagtaccttcaacttcttcataattgtag

SEQ ID NO: 7738 - DNA, 60 bp, Homo sapiens
ccagttgcctgttacagaataactcttcttaactaaaaacctagtcaaacaaggaagctg

SEQ ID NO: 7739 - DNA, 60 bp, Homo sapiens
ctgctatccgtatgtggtggattagaaatgtgttaaatctgcaaaaggtataaagatgtc

SEQ ID NO: 7740 - DNA, 60 bp, Homo sapiens
aggatcatactagaagactaccatgatcatggtttactgcgcgtccgaatggtcaacctt

SEQ ID NO: 7741 - DNA, 60 bp, Homo sapiens
tgtttctccagtattacctcaacgagcagggagatcgagtctatacgctgaagaaatttg

SEQ ID NO: 7742 - DNA, 60 bp, Homo sapiens
ttttgtgtaactatttgtaccgtaggacagaatgtgaggaggaagtaacacacagaggag

SEQ ID NO: 7743 - DNA, 60 bp, Homo sapiens
gaaggacatgtaccctttcatgcctacacacccctcattaaagcagagtcgtggcatctc

SEQ ID NO: 7744 - DNA, 60 bp, Homo sapiens
caggtctcaaagcaggaacagtgggtttgtgtctcacctgagtatctggaattttatttt

SEQ ID NO: 7745 - DNA, 60 bp, Homo sapiens
gcaaaaccagacgtctgggaataccgtgaacttaaggagtctgattctccgacacaggct

SEQ ID NO: 7746 - DNA, 60 bp, Homo sapiens
actggtctcatagttcttatttgcctacatttagagtctgtagatgcatatgcaaccaaa

SEQ ID NO: 7747 - DNA, 60 bp, Homo sapiens
gctgtgattctataatacagactggtgtcttagaggtaggaataatacatgattatgaag

SEQ ID NO: 7748 - DNA, 60 bp, Homo sapiens
ctgcttatatctgtggattcaagttactgaagtgaataccaataaaaagaaaaccctagg

SEQ ID NO: 7749 - DNA, 60 bp, Homo sapiens
aaatgaagccaaagccagctcttccatcttaatcgacgaatcagagcctaccacaaacat

SEQ ID NO: 7750 - DNA, 60 bp, Homo sapiens
aatttatccatcaccaaccatttcttcttggataccatcaagtaacagctattatttgcc

SEQ ID NO: 7751 - DNA, 60 bp, Homo sapiens
cctcagggcactgagagagaaatggaagaaacccccacctctcggaatagcttcccgttc

SEQ ID NO: 7752 - DNA, 60 bp, Homo sapiens
tgagccttttgttttacggtatattgtaaacttttatgttaaagaaaaaatatacattta

SEQ ID NO: 7753 - DNA, 60 bp, Homo sapiens
caccacacacgaaggatctaaccacttcattttccatggtctaatcattaaattcccaat

SEQ ID NO: 7754 - DNA, 60 bp, Homo sapiens
cttgaacaagtcttgaagatcttggtcattttatgacaatggatctaaaatgtcagcatc

SEQ ID NO: 7755 - DNA, 60 bp, Homo sapiens
cgagggcagctccacaccatttcatgtatttttaaacccaactcctagcactgaagatgt

SEQ ID NO: 7756 - DNA, 60 bp, Homo sapiens
aatgaaatattagttggaagacttcacgaagactgctgataactatctgtgattgatagg

SEQ ID NO: 7757 - DNA, 60 bp, Homo sapiens
tagcgaggaggacctgaaagccatccaggacatgttccccaacatggaccaggaggtgat

SEQ ID NO: 7758 - DNA, 60 bp, Homo sapiens
ggtattttgaagtactgggcttatatttcattggaatacatgtgtacagcaataagcagg

SEQ ID NO: 7759 - DNA, 60 bp, Homo sapiens
acaagtagggaaaaacagctaacctggagagaaagaatttctttaacctttatgttcttc

SEQ ID NO: 7760 - DNA, 60 bp, Homo sapiens
ggcattgcataaacttctctggtgtgaaaggataaatatgcctttctaaagttgtatatc

SEQ ID NO: 7761 - DNA, 60 bp, Homo sapiens
tctttacttttgatactgtgaagatctttcgtgccgaaagataaagcaacatttggacac

SEQ ID NO: 7762 - DNA, 60 bp, Homo sapiens
ggtttcgccggcagtctcgatgatagtatttctgctgcaagtacttctgatgttcaagat

SEQ ID NO: 7763 - DNA, 60 bp, Homo sapiens
ctgaaaaataagaagaagatgcagaaacgtgcagataaaatcgccagcaagctgtctgat

SEQ ID NO: 7764 - DNA, 60 bp, Homo sapiens
aaatgtatctgtgttacgacattaattgcaaatagcaagtatggtgctaaagtctacacc

SEQ ID NO: 7765 - DNA, 60 bp, Homo sapiens
ttcatgctggatcaaatgttttactttcccagactggtggcatctgagttccccatccta

SEQ ID NO: 7766 - DNA, 60 bp, Homo sapiens
ggacttttccgtgagccagacgatgctggaggaggtattcttgtacttctccaaggacca

SEQ ID NO: 7767 - DNA, 60 bp, Homo sapiens
tgtgtaacgaattctttgaaggcttcccagataagcagcccaggaagaaatgaaaactcc

SEQ ID NO: 7768 - DNA, 60 bp, Homo sapiens
cagataagatttttacctggaaattccatgaccaatacatgtgcaaaagaaaatgatggg

SEQ ID NO: 7769 - DNA, 60 bp, Homo sapiens
cccacactccaccaaagttctcatgcactatgcactcagaaaaatccaggcttatttttt

SEQ ID NO: 7770 - DNA, 60 bp, Homo sapiens
tcccattccatctcttgaaaaaatgtagtctttgaatgtgtgaaaatctagggacattca

SEQ ID NO: 7771 - DNA, 60 bp, Homo sapiens
gagacttggataatgcaatagaagctgtggatgaatttgcttttctggaaggtactttag

SEQ ID NO: 7772 - DNA, 60 bp, Homo sapiens; identical to SEQ ID NO: 6513

SEQ ID NO: 7773 - DNA, 60 bp, Homo sapiens
tctgagactcctacaggagccaaatttgtaatttagagacacttaattttgttaatcctg

SEQ ID NO: 7774 - DNA, 60 bp, Homo sapiens
gttgccagagataaagtgaaaagtgctttaggtgagatgactaaattatgcctccaagaa

SEQ ID NO: 7775 - DNA, 60 bp, Homo sapiens
gccaactctaacaggcactttgagatgtgttcctcctgctgtagtcctttctgccttggc

SEQ ID NO: 7776 - DNA, 60 bp, Homo sapiens
cacaaaatacgccactccttctgctcagttaagagttatttgtccctactgctacttcct

SEQ ID NO: 7777 - DNA, 60 bp, Homo sapiens
tgcaagagaaggtgccaaagtcatagccacagacattaatgagtccaaacttcaggaact

SEQ ID NO: 7778 - DNA, 60 bp, Homo sapiens
atttatcatttatctgaaatcacatgtagcagattgcatagtctgtaatcctctcagagg

SEQ ID NO: 7779 - DNA, 60 bp, Homo sapiens
atcactcgaactccagcttcagaatgtgttttcatgcccggcctttgttcctccataaat

SEQ ID NO: 7780 - DNA, 60 bp, Homo sapiens
aaagcacatttgccaatgctaactggctgttgtaataataaacagataaggctgcatttg

SEQ ID NO: 7781 - DNA, 60 bp, Homo sapiens
cccagcaaggataacattcaaaggagctcacatttatggaatggatgaatcaataaatta

SEQ ID NO: 7782 - DNA, 60 bp, Homo sapiens
atggagttgctagtaaagcgaagctgattatcctggaaaacactatttacctattttcca

SEQ ID NO: 7783 - DNA, 60 bp, Homo sapiens
ggagggaataggggatgttttatcagtgaatgtgccatacaccttatggtccacttcatg

SEQ ID NO: 7784 - DNA, 60 bp, Homo sapiens
gcatccaaatgggtaggcaggtgacagccgccgtatttattttgcataatattttaattt

SEQ ID NO: 7785 - DNA, 60 bp, Homo sapiens
ctgggttgatacctgaaagaatcctgtcttatttggtctccataatcctttgaatggaaa

SEQ ID NO: 7786 - DNA, 60 bp, Homo sapiens
gtgctgtaagtagaattcatcaacggtctcctaatttttgcatctacatctggggggaaa

SEQ ID NO: 7787 - DNA, 60 bp, Homo sapiens
gatagtcttagttatcttttgagtaagaaaagctttcctaaagtcccatacatttggacc

SEQ ID NO: 7788 - DNA, 60 bp, Homo sapiens
cagatcgatttgtctcaatgaaggttgatttcatcagactaaaaagttacaggaatgacc

SEQ ID NO: 7789 - DNA, 60 bp, Homo sapiens
ccgtaggcttgaacatgtgttgagtgcatgaaaaataaatgctgttcatgtgtgtagctc

SEQ ID NO: 7790 - DNA, 60 bp, Homo sapiens
ccctgatcaacttcctggagtttatatcccctcaggataatctattctctagcttaggta

SEQ ID NO: 7791 - DNA, 60 bp, Homo sapiens
agatctcttggcttccctaacttagtccaggaacacagccttgttcttctcttcctgaat

SEQ ID NO: 7792 - DNA, 60 bp, Homo sapiens
aaattcgtcatttggaagtagtacaactcattgctggaattgtgaaattattcaaggcgt

SEQ ID NO: 7793 - DNA, 60 bp, Homo sapiens
gccatttactactttctggtagactaccatactgatatattaaaagagaaatacagaggg

SEQ ID NO: 7794 - DNA, 60 bp, Homo sapiens
tccttcgtagttcaacaagtgaaggtttattactgaagattgatccattgttgcctaaag

SEQ ID NO: 7795 - DNA, 60 bp, Homo sapiens
gcttacagccctcaatatctctctgctaacaccagtgtctctttctagttaggcctctaa

SEQ ID NO: 7796 - DNA, 60 bp, Homo sapiens
tttatgatcctggttcttcccgttgtctttgagacggagaagttgcaaatggagcaacag

SEQ ID NO: 7797 - DNA, 60 bp, Homo sapiens
attaaacttgctgcatatcttgacatatcttgagattctgcatgtcttgtaaagagaggg

SEQ ID NO: 7798 - DNA, 60 bp, Homo sapiens
aggatttataaaaggcagaaatagcactccattaactctttttcctatcaaaagcagctc

SEQ ID NO: 7799 - DNA, 60 bp, Homo sapiens
cctgggatatttctggaaccgacagcactcccaaaggcactccagcaccaatctgacctc

SEQ ID NO: 7800 - DNA, 60 bp, Homo sapiens
gttctcctagaagacagaattcttacatgccccgtctccatctagcaggaaaagccatat

SEQ ID NO: 7801 - DNA, 60 bp, Homo sapiens
tggatttctaaggatggtggtttgagccttgattagacttttgatgtgctaagccagaca

SEQ ID NO: 7802 - DNA, 60 bp, Homo sapiens
acactggtttccttgggtcttctcaggaccgtagtgcctaccagacgattgactcagcag

SEQ ID NO: 7803 - DNA, 60 bp, Homo sapiens
acatacctctcctacgtattattttcttgacccaaatgaaatattaacctaaggtcaagc

SEQ ID NO: 7804 - DNA, 60 bp, Homo sapiens
cccttgccctaggaaaaaggctgcatctttatatgttacattcatataaactttgtaact

SEQ ID NO: 7805 - DNA, 60 bp, Homo sapiens
ctgtctcataaaagatagagtgactattaccaattgccttctcatgaactcagtcactgt

SEQ ID NO: 7806 - DNA, 60 bp, Homo sapiens
cctgatcaaggacatttaaagtttacagtggtaagtgatcctctggatgaagaaaagaaa

SEQ ID NO: 7807 - DNA, 60 bp, Homo sapiens
ggtaataggagaataggtgaaataacacatgtgggcattttcacaacaatctctccccag

SEQ ID NO: 7808 - DNA, 60 bp, Homo sapiens
tttacaagcatgtctcaagctagtgtgttccattatgctcacagcagtaaatgcctacct

SEQ ID NO: 7809 - DNA, 60 bp, Homo sapiens
aggggtttcctgtggccgtttgaactttgagcatttatctaaattaaattggcccagggt

SEQ ID NO: 7810 - DNA, 60 bp, Homo sapiens
caggccaagttttgatcgttccatacagtaccttgtttatctgcttcttaaagaatcagc

SEQ ID NO: 7811 - DNA, 60 bp, Homo sapiens
aaagcttttacctggttctcataccttattcagcataagagaattcatactgggcagaaa

SEQ ID NO: 7812 - DNA, 60 bp, Homo sapiens
tggattctgatgatgaaaacgtagagtatgaagatgagagtggacatcgttaccgtttgt

SEQ ID NO: 7813 - DNA, 60 bp, Homo sapiens
ctgccaatgttgtgttttctgcttcatacgatattgcacagtactggtcagtatcaggaa

SEQ ID NO: 7814 - DNA, 60 bp, Homo sapiens
ccatgaatcatcttccccacacacaatcattcatatctactcacctaacagcaacactgg

SEQ ID NO: 7815 - DNA, 60 bp, Homo sapiens
ggagctgataaaccaagtcacatttgcattctgttgcaggcttagtgaaaaaggactgct

SEQ ID NO: 7816 - DNA, 60 bp, Homo sapiens
ccccgagaagcaggagcagttcgtggacttgtacaaggagtttgagccaagcctggtcaa

SEQ ID NO: 7817 - DNA, 60 bp, Homo sapiens
ccaagtacaagtgcaaattaactgccctggtcaagtgtgtcagtgactgcacattggttt

SEQ ID NO: 7818 - DNA, 60 bp, Homo sapiens
cctaatatttagggcaataagcagcattggcctggagtgccagagcgtcacctccagggg

SEQ ID NO: 7819 - DNA, 60 bp, Homo sapiens
tgatgattactcaaggcaatatgcagctcaaggagttagaaaaaacacttgctttagcaa

SEQ ID NO: 7820 - DNA, 60 bp, Homo sapiens
ctaataatgcttgtcttggtcttgtttggttacggggtcctaagccccagaagtctaatg

SEQ ID NO: 7821 - DNA, 60 bp, Homo sapiens
agggcaacattgtcaccaagaaggatcacacctcgacacccaacccctgaaccccacaca

SEQ ID NO: 7822 - DNA, 60 bp, Homo sapiens
gaacaccaaagatcaacctaccattgacaaaatattccaagacctggatgccgataaaga

SEQ ID NO: 7823 - DNA, 60 bp, Homo sapiens
agactcctggacccctatatacgtatccaaggcctggatgttcctaaactgagagagcac

SEQ ID NO: 7824 - DNA, 60 bp, Homo sapiens
gtgtgggtgggcgtgatccgctacctgaccttcttccacaactacaatatcctcatcgcc

SEQ ID NO: 7825 - DNA, 60 bp, Homo sapiens
caaagtagaagagctaaagaaaaaatacgggatatgagagactggatttggttactgtgc

SEQ ID NO: 7826 - DNA, 60 bp, Homo sapiens
tgcactgggttgagttccagaacaagttctatgtcggggatggttacaagttttctccat

SEQ ID NO: 7827 - DNA, 60 bp, Homo sapiens
gtgagggacaagaagttccatttgatgtcaataaagcaaagtacttgcctacttttttga

SEQ ID NO: 7828 - DNA, 60 bp, Homo sapiens
gtgtaaataattagcaagcaaatgcgtttctgtgacttcaggtaccagcttaaagagcac

SEQ ID NO: 7829 - DNA, 60 bp, Homo sapiens
gaggaccaattctgtatgcatctaatttcatttgcgtaatacatagttttgagccataag

SEQ ID NO: 7830 - DNA, 60 bp, Homo sapiens
tcgtggcactaacttggaaaagggttgatttaaaataaaagggaagactattttacaagc

SEQ ID NO: 7831 - DNA, 60 bp, Homo sapiens
ctttgcaaaagcttttagaaggaaaagaaagaggattaaagagaattgctggtgatccta

SEQ ID NO: 7832 - DNA, 60 bp, Homo sapiens
aagtatgctttctcctgaaaactttagcattgggtgcaaatattcagtatggttctcgga

SEQ ID NO: 7833 - DNA, 60 bp, Homo sapiens
tggtgtggattgagaacttgttacttgaagaaaaagaattttgatattggaatagcctgc

SEQ ID NO: 7834 - DNA, 60 bp, Homo sapiens
cacacttactgagtacagatgaaggaaagtggtagcaatttaatcataactttcatttgc

SEQ ID NO: 7835 - DNA, 60 bp, Homo sapiens
cactgtgggggtgggggaggatggtgaaccatgtatttcagtgaaatatttaatatattt

SEQ ID NO: 7836 - DNA, 60 bp, Homo sapiens
cttgtagagattgagaaggtggttctacaccctaactaccaccaggtagatattgggatc

SEQ ID NO: 7837 - DNA, 60 bp, Homo sapiens
tctctgccaccaccccataatcccattcaaagaatactagaatggtagcactacccggcc

SEQ ID NO: 7838 - DNA, 60 bp, Homo sapiens
tacaggcctggtactgtcgccctccgtgaaatccgccgctatcagaaatcgactgagcta

SEQ ID NO: 7839 - DNA, 60 bp, Homo sapiens
caactttcccatcttgtctctcttggatgatgtttgccgtcagcattcaccaaaataaac

SEQ ID NO: 7840 - DNA, 60 bp, Homo sapiens
ttccaaaagagcctcaacgactccatccagcctgacccgctctgtctgcacaactcgtca

SEQ ID NO: 7841 - DNA, 60 bp, Homo sapiens
aaacataaatctggcctacatgcacatccgggcatagtaccttcccttgaacttaatcat

SEQ ID NO: 7842 - DNA, 60 bp, Homo sapiens
tgtccttgaccacatgaagaaactggatgtcagcagtgatgggcagttagatttcccaaa

SEQ ID NO: 7843 - DNA, 60 bp, Homo sapiens
ggttgcagaagttttacaagtacctccaatgagagtatatgaagtagcaactttttatac

SEQ ID NO: 7844 - DNA, 60 bp, Homo sapiens
tcagggaagagtgaaaagggtcagccacagaattccaagaagcaaagtccaccaaaaaag

SEQ ID NO: 7845 - DNA, 60 bp, Homo sapiens
gggaccattcattccctggcattaatcccttagagggaataataaagctttttatttctc

SEQ ID NO: 7846 - DNA, 60 bp, Homo sapiens
ctactttaacaccaggtttatggaaaatgtcaggccttccccacaactcctgtctaactg

SEQ ID NO: 7847 - DNA, 60 bp, Homo sapiens
attaatattttcctttgttaaaggaggaaccgtaactctccatagctgtacatataaccc

SEQ ID NO: 7848 - DNA, 60 bp, Homo sapiens
aacgagactgcacggattgttttaagaaaatggcagacaaaccagacatgggggaaatcg

SEQ ID NO: 7849 - DNA, 60 bp, Homo sapiens
taataggaaacccttgcctcatcagttttcctgatttacaagtgcaatattttagccaat

SEQ ID NO: 7850 - DNA, 60 bp, Homo sapiens
accttgtcctcccacctccctgaactgtccattgcttttatagggtgaggtaagtgacag

SEQ ID NO: 7851 - DNA, 60 bp, Homo sapiens
atctctatcccctatgaggcaccacgtaagacctcctgcccttagctctcttgctcacca

SEQ ID NO: 7852 - DNA, 60 bp, Homo sapiens
aaagtactagaagaatacaagaaaaagttcagtgacatctctgagaaacttatggagcgc

SEQ ID NO: 7853 - DNA, 60 bp, Homo sapiens
gccacccatgaaagcatttctgaagcccctttctaagacaaggctcagcatcttgatatt

SEQ ID NO: 7854 - DNA, 60 bp, Homo sapiens
ttctctgtgactgagagccctagtgtgatgagaactaaagagaaagccagacccctaaaa

SEQ ID NO: 7855 - DNA, 60 bp, Homo sapiens
ttctgtaattatgaagaatcaaacaccaacaaagaagtatgatggctacacatcatgtcc

SEQ ID NO: 7856 - DNA, 60 bp, Homo sapiens
aatggccgtttttggaattacttgataagaacttttgaaaatggaaggattagtatggcc

SEQ ID NO: 7857 - DNA, 60 bp, Homo sapiens
ggatagtataataacaataaggagtaagccaccttttataggcaccctgtagttttatag

SEQ ID NO: 7858 - DNA, 60 bp, Homo sapiens
ataacattattatgagaaagtggacttaaccgaaatggaaccaactgacattctatcgtg

SEQ ID NO: 7859 - DNA, 60 bp, Homo sapiens
ccagagggtagggcagcagatcttctttataactatttattgttcgaatcacttttagga

SEQ ID NO: 7860 - DNA, 60 bp, Homo sapiens
ggctcaagacagtcctgaaatacgtgctgtttcttctgggtacactggtcatcgccatgt

SEQ ID NO: 7861 - DNA, 60 bp, Homo sapiens
accctgaatcataatcgctcctttgcacctctaaaaagatgcccttaccctcattctgga

SEQ ID NO: 7862 - DNA, 60 bp, Homo sapiens
ggattgggcgtatctataccagtgggagcaccaactacaacctctccctccagagtcgag

SEQ ID NO: 7863 - DNA, 60 bp, Homo sapiens
aaaggattgtgcgcattggcgagaaatgatcgttgacatgtctgtcaagaccaagattca

SEQ ID NO: 7864 - DNA, 60 bp, Homo sapiens
ataaatctggcctacatgcacatccgggcatagtaccttcccttgaacttaatcatgaca

SEQ ID NO: 7865 - DNA, 60 bp, Homo sapiens
gtgatttccagtgagtgtaaataattttaaataacctctggcccttggaataaagttctg

SEQ ID NO: 7866 - DNA, 60 bp, Homo sapiens
acctaacttcccaccctactcatcttacacctgctctagacaaagttgttgaatgactta

SEQ ID NO: 7867 - DNA, 60 bp, Homo sapiens
cacaggtaggatgggacccttcatgaatatctgactttaataagttggtaaggatatatt

SEQ ID NO: 7868 - DNA, 60 bp, Homo sapiens
gacaacaacacacttgtgttcattgttgatgttaaagccaacaagcaccagattaaacag

SEQ ID NO: 7869 - DNA, 60 bp, Homo sapiens
atctggcaagttagtcacagtcagacatggacagttgatccatgaggaaaagatgctctc

SEQ ID NO: 7870 - DNA, 60 bp, Homo sapiens
aaatcagaagaaagatgaggaacaggccctcctctctctccaggcaggctttggtggagg

SEQ ID NO: 7871 - DNA, 60 bp, Homo sapiens
gctcgaagaggtaatgatgctgtaatgacaagaggcacttttgcaaatatcaagcttttt

SEQ ID NO: 7872 - DNA, 60 bp, Homo sapiens
gctcgtccccagagtttcacatgactcgttctctcgcttcatccaggtgtcctgctgaaa

SEQ ID NO: 7873 - DNA, 60 bp, Homo sapiens
acaggggcatttagggagcagatgactgagaacattaaaaaagaacttaaatgacacagc

SEQ ID NO: 7874 - DNA, 60 bp, Homo sapiens
ttgggtgacaagtttcggttggtcatagctagtaccttgtatgaagatggtaccctggat

SEQ ID NO: 7875 - DNA, 60 bp, Homo sapiens
aactaatctgggttgtaatacagtttataccagtgtatgctctagacttggaagatgtag

SEQ ID NO: 7876 - DNA, 60 bp, Homo sapiens
gtggtaacactgatccttcagaagaagcttcattccctcttaatctagttaagccaggac

SEQ ID NO: 7877 - DNA, 60 bp, Homo sapiens
ctgacttctaaatagtttcctgcttagaatccttaggaggaattaggatctcctttcagc

SEQ ID NO: 7878 - DNA, 60 bp, Homo sapiens
ttgtgccaagtacgagatctattgttggaagtctttggtatatgcaaatgaaaggagagg

SEQ ID NO: 7879 - DNA, 60 bp, Homo sapiens
taaaatacttcaatcctggattcacagtgggaacaagtttctattaaaaggcaaatgctg

SEQ ID NO: 7880 - DNA, 60 bp, Homo sapiens
taatctctttagtaaattaacttcaaaactcacaaggagtcgcaatgtatctgctgagca

SEQ ID NO: 7881 - DNA, 60 bp, Homo sapiens
tataggaagcatatgcctacttgtaatttctaactacttatgtttgaagagaaacctccg

SEQ ID NO: 7882 - DNA, 60 bp, Homo sapiens
catcacgctggaacccatggaaatccgcactttcctggcctcagttcaatggaaggaggt

SEQ ID NO: 7883 - DNA, 60 bp, Homo sapiens
ggttctgccttgaaacagcacaatgaagtgtatcagtatattctgtgattatgaaactta

SEQ ID NO: 7884 - DNA, 60 bp, Homo sapiens
gcatttctaattgacctgagggacattccgtttgaaatgtactgaagttacagtttctgg

SEQ ID NO: 7885 - DNA, 60 bp, Homo sapiens
ccctttgaccactttcctgaagagaagttctctttatgaattaagagtacaaaatcctct

SEQ ID NO: 7886 - DNA, 60 bp, Homo sapiens
ctctgagagtctctccgtatgtgaatggggagatccagaaggctgagatcaggtcgcagc

SEQ ID NO: 7887 - DNA, 60 bp, Homo sapiens
ctgctaaattcagtgctaccagtaaggcttaataagtagttcattgaccctgtaagatag

SEQ ID NO: 7888 - DNA, 60 bp, Homo sapiens
cacccctctagtcgaaatattttgtgcttaccccaatatatgtgtgtgactattgaactc

SEQ ID NO: 7889 - DNA, 60 bp, Homo sapiens
cattcctctagggaaaggtcaagaaataaatttggcttgattgtattctctcatttacca

SEQ ID NO: 7890 - DNA, 60 bp, Homo sapiens
atcagtgactgtctaggaggatcccttgccttgtaggtgccccaagaccgcagggtagaa

SEQ ID NO: 7891 - DNA, 60 bp, Homo sapiens
caaaaagattaccaggggtaaaacaactttttcatgggtcaaaatcatcttccgaagaaa

SEQ ID NO: 7892 - DNA, 60 bp, Homo sapiens
ggcgtcttttcctgaagacacttctataaggtatttagaaatctatcaggagtgagaatc

SEQ ID NO: 7893 - DNA, 60 bp, Homo sapiens
aaagaaatgctagaatcatcaagtggttatatagcatcaaacaagctagagagtcacaga

SEQ ID NO: 7894 - DNA, 60 bp, Homo sapiens
ttctgccttttgctggtgtttctggaatttgctttccctcacctctcacttccttctaga

SEQ ID NO: 7895 - DNA, 60 bp, Homo sapiens
gccatagagcctgaaatcatctttgttggctcagaaaataccttagcttcactcagctgg

SEQ ID NO: 7896 - DNA, 60 bp, Homo sapiens
gaggagtaccatctatatagggaaaacaaatcagcatcctgggttagacggatacaagag

SEQ ID NO: 7897 - DNA, 60 bp, Homo sapiens
tctaattctaaaatgctgatcttctctggagtctatggtaggcaattatggtcactggaa

SEQ ID NO: 7898 - DNA, 60 bp, Homo sapiens
atgctcagaagttgcctatgtgtgacaaatgtggcactgggattgttggtgtgtttgtga

SEQ ID NO: 7899 - DNA, 60 bp, Homo sapiens
tccattggatttctaaaatgtattgtgaatttctcagacaaacaggatttatgctggagc

SEQ ID NO: 7900 - DNA, 60 bp, Homo sapiens
acagagaaaatggaggtccccagtctaggtaggaagctgattggatgaggacttcttttt

SEQ ID NO: 7901 - DNA, 60 bp, Homo sapiens
aaaggcctattctactcttatttaaagtgaaacactgtatacttgtttctctccaaagcg

SEQ ID NO: 7902 - DNA, 60 bp, Homo sapiens
atgaaatgagaaaattattggacaattcagactttactaaagcacagttagacccaaggc

SEQ ID NO: 7903 - DNA, 60 bp, Homo sapiens
agccctggaagtggagttaggagcttctaacccgtcatggttcaatacacattcttcttt

SEQ ID NO: 7904 - DNA, 60 bp, Homo sapiens
cgccctcaatgacatgacctctatataattatcaccgtttctgctctgttctggatctgc

SEQ ID NO: 7905 - DNA, 60 bp, Homo sapiens
gaatacaaatgaaaccccttctttctctttccgtccaacaactctgtagagctctctgca

SEQ ID NO: 7906 - DNA, 60 bp, Homo sapiens
agccaccatggtgtctttgctttcctggtgaccccatccccctatgagctttgtgctgtg

SEQ ID NO: 7907 - DNA, 60 bp, Homo sapiens
tgagggtgtttgtgccttgtgagactccgtacattaaagacctgtctcttcttccctgtc

SEQ ID NO: 7908 - DNA, 60 bp, Homo sapiens
gtaagacgtatgtaacatgatgttaactttgtgtggtctaaagtgtttagctgtcaagcc

SEQ ID NO: 7909 - DNA, 60 bp, Homo sapiens
aatgatttgctctttgacaactaaaattaggactgtataagtactagatgcatcactggg

SEQ ID NO: 7910 - DNA, 60 bp, Homo sapiens
aggtactcagcgaatgaatgctgtatatgttgggtgcaaagttccctacttcctgtgact

SEQ ID NO: 7911 - DNA, 60 bp, Homo sapiens
taaattacatccagaaatccttcggattaaacatggaagttatgaagatgctgttcactc

SEQ ID NO: 7912 - DNA, 60 bp, Homo sapiens
gacactgtgatggtgttcttaagctcatagagtggcaggttgtctgaaatgccaccatcc

SEQ ID NO: 7913 - DNA, 60 bp, Homo sapiens
cctttatcctcacacgcttttctacaatggcattcaataaagtgcacgtgtttctggtgc

SEQ ID NO: 7914 - DNA, 60 bp, Homo sapiens
atttgctatgaagggttgatggattaattaaataagtcaattcctggaagttgagagagc

SEQ ID NO: 7915 - DNA, 60 bp, Homo sapiens
tgacttcttcacccgagtggcgctcttccgagactggatcgatggtgttctcaacaaccc

SEQ ID NO: 7916 - DNA, 60 bp, Homo sapiens
gtgtaaaagaattgccgatatttctcaggtctacacacagaatgctgaaatgaggcctct

SEQ ID NO: 7917 - DNA, 60 bp, Homo sapiens
tattgcaatagcactaaagactgtgtaacaccaatgcaggcaaatcagcctttggggatg

SEQ ID NO: 7918 - DNA, 60 bp, Homo sapiens
acaccccaaaacacatacattgaaagtgcctcatctgaataaaatgacttgtgtttccct

SEQ ID NO: 7919 - DNA, 60 bp, Homo sapiens
gaccaatgagtcagattttagagacactgaataagtgtccacattttaaaagacagagga

SEQ ID NO: 7920 - DNA, 60 bp, Homo sapiens
cacagaacataaagggtgagagaaatctgttaatataatgataatgagaacacctttgcc

SEQ ID NO: 7921 - DNA, 60 bp, Homo sapiens
atgtatctaagaagcatgtcactttcatgttcctccctaactccctgacctgagaaccct

SEQ ID NO: 7922 - DNA, 60 bp, Homo sapiens
tggcacagaacatggactctgtgtttaaggagctcttgggaaagacctctgtccgccagg

SEQ ID NO: 7923 - DNA, 60 bp, Homo sapiens
aactttcctctgaagataaggagaccatggaaaaagctgtagaagaaaagattgaatggc

SEQ ID NO: 7924 - DNA, 60 bp, Homo sapiens
tgtgggttacgtgtctggctggggacaaagtgacaactttaaacttactgaccatctgaa

SEQ ID NO: 7925 - DNA, 60 bp, Homo sapiens
ctccttgtcattgaccttagctaaaccatggcaattcataaatagaggaaacattaatga

SEQ ID NO: 7926 - DNA, 60 bp, Homo sapiens
acatctaacaatttcactgtaacagtgaccgataatgtgagaaatgtgctttttacagtg

SEQ ID NO: 7927 - DNA, 60 bp, Homo sapiens
gaccctggcttctgaaaggctcgctctcatcttgtacataccaccacaaactcaaccagg

SEQ ID NO: 7928 - DNA, 60 bp, Homo sapiens
atttacctcccaactgccatgtgattaagaaatgggtcttgagtcctgtgctgttggcaa

SEQ ID NO: 7929 - DNA, 60 bp, Homo sapiens
ttcctctaaacctacgagggaggaacaccttgatcttacagaaaataccacctcgagatg

SEQ ID NO: 7930 - DNA, 60 bp, Homo sapiens
agactgcatttaggagatagaaaatagtttggattacttaaaggaataaggtgttgcctg

SEQ ID NO: 7931 - DNA, 60 bp, Homo sapiens
tgactcccctactgaaactctcctgctcaaacacacacctcaatgaggtcataatcctta

SEQ ID NO: 7932 - DNA, 60 bp, Homo sapiens
tgaggcaagtcaccagcccctgatcatttcgcctaaaagagcaaggactagagttcctga

SEQ ID NO: 7933 - DNA, 60 bp, Homo sapiens
aagcgttcctggccttctgaactccatacagcctctacagccgtcccgcgttcaagactt

SEQ ID NO: 7934 - DNA, 60 bp, Homo sapiens
ggcttgagtggatgggacggatcaaccctaacagtggtggcacacactatgcacagaagt

SEQ ID NO: 7935 - DNA, 60 bp, Homo sapiens
cctgcgctcccctcctcagtacacggccaatctgttgcataaatacacttgagcattttg

SEQ ID NO: 7936 - DNA, 60 bp, Homo sapiens
ccctcatccgattcccctgtagcagtcactgcacagttaataaacctttgcaaacgttaa
